United States Patent 9,441,016 (COMPLETE GENOME SEQUENCE OF THE METHANOGEN METHANOBREVIBACTER RUMINANTIUM) - sequence listing, part 2

SEQ ID NO: 5698 - DNA, 525 bp, Methanobrevibacter ruminantium
aaaacttaaaatcatctttaatttatgaatcaaagccctttttaaaaaatattaaacttcctaattaaccttctagctcagaataaaattatcaaattaaatcgcttaaaaggcaatagtccaaaaaagattttcaagaccattgaaaattaaattctaaaagaattaaattaagccaattactataatcaacttaagtcataaaaagccaaaatagaatcgactttgctcttttcgaattaaattaagccaattatttcaattaacttaatttaaaacttcaagaaaaaaaggaatttaattttaattattttatctgaaattacagtacaccccttaaatttagtacttactaatcattttcatatcctttgattgtcttgaaatataaaaatatcaatcaattattgaacagataactaaattaatattccatatttaacttatcatagataacgctcgaaataattaatagtgattatatatttagtcataatattatataaatattgttaaatgatatga

SEQ ID NO: 5699 - DNA, 124 bp, Methanobrevibacter ruminantium
ataaaaaaaagcaatatcttatcattataaagacaattaaatctaaaataatgaaaaataaaaaataaataaaaaaaataaatcaatttagattaattaaatattcaaaacaggacctaatcaa

SEQ ID NO: 5700 - DNA, 188 bp, Methanobrevibacter ruminantium
ctcatagataaataaaaaaaagaagtaaatttagaataataagttcaaaacaatgataaaataataatatttcaagatttaagtttttagataaacaataagttcaattatttaaaataattaattcacagaaaaaagaaaaataaatagtttaaaactaaaaaaaattaaatttttagatttaaact

SEQ ID NO: 5701 - DNA, 82 bp, Methanobrevibacter ruminantium
ttttacactccaaatatgcaatagttttaaatttagattatatataaggttaatttttttaaagaatttttattgaataaat

SEQ ID NO: 5702 - DNA, 487 bp, Methanobrevibacter ruminantium
aaaagtaattataaactatctagcaagagttcagtttcatacaactttcacactctcacatcaattttacgaaatgacaacaatttcacacgacgaagtcaatttcacattttaatacaactttcacacgatgacatcaattttacgaaatgacaacaatttcacactttcgtacaactttcacacgatgacatcaattttacgaaatgacaacaatttcacactttcgtacaactttcacacgatgacatcaatttaacactatgaagtcaattttacgaaatgaaatcaattttgatgtaaaagtgttaaagaagcaatataaatactttatatttaatataaagactattaaatgctctaaaaagcaaaatatttatatatctgttcgttcatacctttaactacacccccaaaaatagggatgcctaggtgaaataaaatttcttgcaaaaaaataggggaaaaatataaacgagcagatact

SEQ ID NO: 5703 - DNA, 115 bp, Methanobrevibacter ruminantium
cttccctccaagaaaaaactcaaattatccttgctattttaacagtttaataagttttaaccagaagagatatttttctgatgtagaagggtatgaactaatcagcatccctaga

SEQ ID NO: 5704 - DNA, 37 bp, Methanobrevibacter ruminantium
aaggattaaacccctcatttagacaaaaacaaaaaaa

SEQ ID NO: 5705 - DNA, 190 bp, Methanobrevibacter ruminantium
aaaattcctcgtgttttatgaataaaatcataagtatttagtccaaatagttaaaataaaatgtatttactcctaagagttaaaattaagggtatttacccccaataattaaaattaagggcatttgtaccatatatgtaataaaatttttagtccagcttttacgtctcaaagggccgttaaaagtgat

SEQ ID NO: 5706 - DNA, 480 bp, Methanobrevibacter ruminantium
aacattacttccagtatctaataaaaaaaaaataatcttaataaatcgataataattaaatatctaatattataatttatgcattttgattataaaatactttattataattcgagttttttacttggaaattttaattgcactactatttttatggttgaatataagagcatttttacacatgcttaaacaattttgacaattataatcttttaaaaaagtttaatctataagtaaaactattgctaaaatgataaaagtttaaagtataaataaaactaaaaaaatagacaaattaactaaataaaaactatcaaagcttaaaaaccattaaaatataaaaataagcaaattaactgaataaaaactatcaaagcttaaaaactattaaaatataaaaatagatgaaataaataactaaaacgataaaaaaaatcttaaaagtcattaaaaaaagaaatagctaagggaattgcttaa

SEQ ID NO: 5707 - DNA, 52 bp, Methanobrevibacter ruminantium
atcacatgcaacacctgccctatacaatagagcattttcttcatcactagat

SEQ ID NO: 5708 - DNA, 289 bp, Methanobrevibacter ruminantium
aaatatcctctccaataagttttttgattatttatagtaaggtctttttaaaactccttaaaaaaattaattaatgagtaaaatgagaaacaacttttattttaaaaaatcaaccttttgactaagcaaaataacttaatgactattcaaatcctttcatataccatagttgaaccatagattagattggaatttaaaaaatcctagattaaattatctttgtcaaatgacaatttagaaaaaattaaaaaattattcatcatcttggcctagatagcaaatgataaaa

SEQ ID NO: 5709 - DNA, 171 bp, Methanobrevibacter ruminantium
agttttaattatatgaaaatgttttaataaatttatctaatcagataaaaaacatgaaacgattttttaaaaagaatgaaaaaaagataaaaattatttaaaatagaaaaataaaggcttattaacccccatttcaatagcaattatgaaaatacattaaaaaagataaaa

SEQ ID NO: 5710 - DNA, 530 bp, Methanobrevibacter ruminantium
tttcaatgcacctatttaaaaattattagatttaatttctattatttaatttataaacatacatttataatttttatccaaaattcaaacattatgctaaatttgaatgtctattctttatctatcttatgccttttaggatatttaaaaatttgaatgtctattctttatctatcttatgccttttaggatatttaaaaattttcattgaaaacataaaaaacataaaaaatttttatgattcttatgttacttatgtttcttatgtttttcacttattttatccaattatcaaaatcaacaatcatagaaagatattaatattttattatccaattaatatttgtagagtttataattgacttcataaataataaatggcattaaaaaccatataatgctttttaaggactaaaaatcattaattaatgattaaaactactaaatcagcattatatgaatgagtaaaattattaataaagattataaaaaattctaaaaaaaacaattaaaacttataagatgataaa

SEQ ID NO: 5711 - DNA, 97 bp, Methanobrevibacter ruminantium
aaaaaagttaaaataatgcttaaaaaaaatagttaaaattaacttataataatcgaagaaaacaagcttaaaaatgaattataaaaaattctttaat

SEQ ID NO: 5712 - DNA, 144 bp, Methanobrevibacter ruminantium
ttttatttttttgacttaaaaattagtttgaataatataaaacaaaacaaagagggctaaaaactagcctaaaagagttaaaaattattaaaaagagttaataaaagtagtgaaatgaatataagaaaaaaagaaagaatgaaa

SEQ ID NO: 5713 - DNA, 110 bp, Methanobrevibacter ruminantium
tacaatacctcaaaactttaaaaaatataaacattagaaattattatcaatgagtgatattaatattatatttttaatgtgtaataaacttatttgaaaaaccaaaaaaa

SEQ ID NO: 5714 - DNA, 202 bp, Methanobrevibacter ruminantium
attatgtctccaaaaatttttaaaaaatatttttaattagatttactttgtatcttatattatatattgtttgtgtattatgaaataaaatttttattagggatttaaatctatctagaacattatttaaaaggccaaatctccccaagtattatttaaaagcccaaatcaccataagtattatttaataacctaaatctct

SEQ ID NO: 5715 - DNA, 157 bp, Methanobrevibacter ruminantium
ttatttaagtaagatttaaaaaaaattgaaataattgcttaataaaaaaagaatttttggcttgaatgaatcaagcctaaagcatttaattatttattaaatgtctaataaaaaacaatgaataaataaaaaccaataagtaattaaattgctaaat

SEQ ID NO: 5716 - DNA, 315 bp, Methanobrevibacter ruminantium
attataatatttttatctatgtttttccatattaattaatttatttatttttaaataattctagaaaaatcatcgtaataagtttagaaaaatatctagaaaaacaatcacaaaaagtatagaaaaatatctagaaaaaattctagaaaagtcaacacaaaaagtataaaaaatatcttaaaagaccatctttaagaaggtttttgaaaaacataaactttaaaagtaacaactcccaagctgaataataaaataaaattatatatattgaaaaaatataaatatattatattaaaaaatagattaggtgaaaac

SEQ ID NO: 5717 - DNA, 60 bp, Methanobrevibacter ruminantium
taaaaaaaaagcctaatcttttttaatttttgaatattcatttaatcagttcaaaattaa

SEQ ID NO: 5718 - DNA, 57 bp, Methanobrevibacter ruminantium
ttttcatatttataaatagtttcaccaaatttaaaaagaaattacatatcttaaaaa

SEQ ID NO: 5719 - DNA, 167 bp, Methanobrevibacter ruminantium
tttttttgatttaaatttcttttctacttaaatcttttaaatttctaattttactgatttttcttaaaaatatcttatttaagtaattcactcacatcatctaaattctactgtttttatcattaattttcttaaaatttctaaattaattttcttaaaatttctta

SEQ ID NO: 5720 - DNA, 34 bp, Methanobrevibacter ruminantium
attgaaatacaaatgaataaaaaaagaatttaag

SEQ ID NO: 5721 - DNA, 48 bp, Methanobrevibacter ruminantium
atactacattataaatatagttaacctattatttaaaactttcgatga

SEQ ID NO: 5722 - DNA, 44 bp, Methanobrevibacter ruminantium
atatttaaactacaatacattttaataattaaaaaggtgaaaaa

SEQ ID NO: 5723 - DNA, 36 bp, Methanobrevibacter ruminantium
ttgaccaaaatttttatctacttttaggaaaaacag

SEQ ID NO: 5724 - DNA, 782 bp, Methanobrevibacter ruminantium
gacaattttacgaaatgaaatcaatttaacactttcaaatcaattttacgaaatgaaatcaattttaaattaagaatactaaattgatatgactttgataaagttgtatgagattgttaaaacttagaatcaaaaataaagacttatatactagttgttacaaattataaaatagcaatggaattttcaaacggtcattgaaaaatatcttccattgcaataaacacgaaaagtccctaatgaaatagggcctatttagaaaaactgaatagataattgctcttcgaatgaaaaacattcactctggtattctctcacactataaaagaaaaaatcattgaaaacggcaagaaaaacctctataaaatccaaggaaaaagtaataccaaagcaatggatcccctttccatttgctagatcatccatcgaagagcagaaaggaataataaggtatagaataatcaaataaagtaatatatcttccaatccaaaatacgaacatttcaccccctaaaatcaaaataaggcattaataactcgttgcaaaaatagaaccactcaaagggaaaattataaaacttaattctatacctattatttctttaaaaacgataaatagggcaaaatactctttttaaaaatagatataaaaaataaagcaaattattatataaaaatactctttttaaaaatagatataaaaaataaagcaaattattatataaaaatactctttttaaaaatagatataaaaaatagtaaaaaataaattaaaaaaagaa

SEQ ID NO: 5725 - DNA, 75 bp, Methanobrevibacter ruminantium
taaaaaaaaaataagtaaaaaataaattaaaataataattgcatctaaaaatgcaataaaaagtaaaaaaagaga

SEQ ID NO: 5726 - DNA, 433 bp, Methanobrevibacter ruminantium
ttttatcacttaacgtttgaaataataattaaaataatttaaataaattaattagactaattagttaattaatttatagcacatagtttaaaaagttttatataaattttaaaaattattcacatatagaataagtattcacactatgaataattattcacacaaagaataattattcgacttattcacatatagaataagtattcacactatgaataactatcaacttattcttatctatcattgaaacaaagaatttaaaaagaaaattagaaaaagctcataaattctataaaaaaagttcaagtgtgttaaattaaaaaaataagaccatacagtctaaaaaaagtaaaaaacagaagagagataaactcccaactgaaataatattttggtccagcttttgcgacccgaagggtcggaaaaggtggaa

SEQ ID NO: 5727 - DNA, 116 bp, Methanobrevibacter ruminantium
tttaataactcctttttagtttttaataaatttgtaaaattatttaagccaatggctaataaataactaatccttaagccaatagccaagatatattcaatagaaattagtagtga

SEQ ID NO: 5728 - DNA, 44 bp, Methanobrevibacter ruminantium
tttcaaccgtccttctttttttaataattcaataagtttgattt

SEQ ID NO: 5729 - DNA, 80 bp, Methanobrevibacter ruminantium
attaaaaagatattcgtaaactttaataaaaaagttctagttaattagtttcagactaattaactaactaatacttttag

SEQ ID NO: 5730 - DNA, 300 bp, Methanobrevibacter ruminantium
aatggattcttacttttaaacatcaacaaccacagccatacattattaaaccgctaatagagatttattaaatataaatatatgagccactatttttaaaaataaatttaaatttttcctaataaattaaatcaataaagatataatctttaaaatcaaattaaagaaaccaaacatcttaaataccaaacaatcaatggttaatgatagaaagttttaataatatttaaaaacaaatatttaaatttctatgaagaaataatatcatatttattatcaaaatcgatggggaaatagtat

SEQ ID NO: 5731 - DNA, 201 bp, Methanobrevibacter ruminantium
actgttaaagaactaaaaaaagacttataaaaattatataataagttgttaaaaagcttttaaaaagtaaaatcaaatagaattatcttaaaacagatgaaaagactaaattattaccctcatcaattattaatcgattataaaaaataaaatttatcaattcataaaaaaaaatagtatttaggtaaaaaaggtgggaaa

SEQ ID NO: 5732 - DNA, 12 bp, Methanobrevibacter ruminantium
ataaataaatta

SEQ ID NO: 5733 - DNA, 228 bp, Methanobrevibacter ruminantium
aagatttatatataagatttaaaaatttgcaataaaacaaaatataaataactaattttaaaaaagcacatattaaggcattaaaaaaagcaataatttaatcaaataagaattaaaaaaagtgttaaaaaatgaaaaaatagtggagagatttcctctccttaaaaaaagttgaattcccttctaaacgaagataaaaccaaataataaataaacattttgatcaaa

SEQ ID NO: 5734 - DNA, 5 bp, Methanobrevibacter ruminantium
tttgg

SEQ ID NO: 5735 - DNA, 175 bp, Methanobrevibacter ruminantium
ctaaacaccaaacatttaataaatattataaattagtcagcattaaaaaatgcaatacaaatactgcttttaaacaatatgctaaaaatgcaatataaaagtaagtttctagcaattcaaataagaataaatttcattttaaaataagcatcaaaaaacaatttcttgaaaaaaa

SEQ ID NO: 5736 - DNA, 81 bp, Methanobrevibacter ruminantium
taacgactaattaaaccaacagttaatttaaaaaacatcattttaattatttataaaattaaaataaacaaagaatattaa

SEQ ID NO: 5737 - DNA, 22 bp, Methanobrevibacter ruminantium
atctatttccaaaaataacacc

SEQ ID NO: 5738 - DNA, 16 bp, Methanobrevibacter ruminantium
agatatttaaatttaa

SEQ ID NO: 5739 - DNA, 151 bp, Methanobrevibacter ruminantium
aaaattttttttatacctgttgtcaactagactaaaaagagggttatgtataaactgaaaaagtctatgtataactagagagtatgtaaaagataaaaaagaatgaataaaaaagagttaataaaaataatgaaaaattaaggggatggaa

SEQ ID NO: 5740 - DNA, 272 bp, Methanobrevibacter ruminantium
aatatcattccaatttgttaattataagaataatttgatttcgaatatttattctccttacaataattttagtaagtaatgtttattaaagttataatttttattgaaaaatagattggaaaaagaacgattgatgtaatgaaaaagtaaaaatagacaagaagaaatgattgaattaatgaaaaagtaaaaagagattaaaataagaattaaatgaaaaattaaaaaataataaattaatattaaataggatccagttattataaaaagac

SEQ ID NO: 5741 - DNA, 587 bp, Methanobrevibacter ruminantium
agaaatatctccttaaaaataatttaaattaatcaataaaaatgatctagaaaatctagaaaaaatatctaggaaaataatctagaaagaagatttagaaaaatatcgggaaaaaatgagaaaacaatatacaagaaataaaaaatagcaagtgacaaatctaagttttaagatttaagtaccagaataacaggcaattaactttaaaattttaatagaagtattaatggaagttttaaaaaagggggtgaactaatattattcaaatgcgaaacccattaaaccagcaaaaaatcctaaaacctaaattgtaattatatttttataactcatatgtaattaagttaactatttttttccgataattttataaaaatttaatgatttcgccatatgatgaatcaataattgaaaatatcttgacttcatcatagactcaacattaatttaattattcaatgactcatcattttatgactcatcatcaataaatattcaatgacttatcacttattcgtcatcaaatatataaaaatatatatctattttcttattattaattatttgcatataagtaatactgcaaa

SEQ ID NO: 5742 - DNA, 380 bp, Methanobrevibacter ruminantium
ttaacacacatccttttctttttaatggaattttataagagattcttatctattggtcaattaagacaataaaaatttctataaaataacccagttctttcaatttttcaagaaaagtaaatagcattataatatcaacatagaattattaaaatttaataaaaaggcctaattataagaattataataatctaagcttgtgataagcttaaaactatatgaaatatttttaataactatttaattcctatgtaattaaagatattttagaatttgtatataaagattttgtaactagttaagggtgaaaagtaacaaaatatttttataaaacaactgaaataatagaatataattaggacaatttggttagggatttt

SEQ ID NO: 5743 - DNA, 114 bp, Methanobrevibacter ruminantium
aaaaaaataagagcatattattaataaatataaactttagtggaatagatacctatctcccaactaaagaaatagcaagtttattattttttgcaaggataaacaaatgcctta

SEQ ID NO: 5744 - DNA, 524 bp, Methanobrevibacter ruminantium
accacctaaaattcatcgaacattccactgccataagctgttaacactgtatcaacaccaacaaggcaagtccaggcaaaccagtaggaagagcaatcatacctacttcaaacaataagccgcctatgacacttgcgattaatttaggattggtgaaaagataaaattatcgaaaatagaaattataattaaaacacaaaaataattacaaaagtaaaaattaataaaattattactgaaaacctataaattttagatttatttgaaaatcatctggaattatatgaataacccctatcgaaaataaaaatgaaattaaaagaattaataaagattcacttttcataaatatcccactaagcttttaaaataaaaacatgaaaaataattgctaataaaatcaagataattactatatatatcctttgaattcttttattctcatcaagttgtaaaaatttcttataataaaaagaaattataaaaaatataaataaaaatatgaataagaaaatattattcat

SEQ ID NO: 5745 - DNA, 418 bp, Methanobrevibacter ruminantium
tagagctctataatactagccacttattatactattttataattaaaaagatttgaaaaagtaccaaaaaattaaaaacaataagagaactataattaattttaatatattttcagataatttaaagttatctgataagaaatatggaataacaagagccaatagaaatataacaaagccaataagtattagtaaactattcatcaaatcacctagcaggaattaactgataaatattttaaaatattttaattactgaatgcaatcattaatatcagaactgttattaagaaatatataactaataaaaatttgctttgatttttacttagcctattagttacagtagcttttgaagcataaaaacgcaaaataaaaaataatgcaaacaataataacatcaaaaaatatttaaatt

SEQ ID NO: 5746 - DNA, 466 bp, Methanobrevibacter ruminantium
ttcgccaactgcacaggtacttgagtcggatcctgctagttttatgatttgtttaaagtagttattcctgaacctgcataactataagcaaatttatataacttattgtttttatagatgcctatccttaataaatactaaaaatagatatgagtagtttattatatataaatttaactataagtcatataaatttattattttaaaaaaataaaacgaaaccataagttataagcaaaataaataaaaaatattcagaaaatatattgataactgaataaaaaaatatgaaacaaaaatagaaatgaagattattcaaaagaagaattaattattggacaatgcaaaataaaatatattgaaaaaaatcttaagaagcagggaaaaagaataaattttataaaaacttaaagaaaaagagttgatttaaaattaaatatttttaaaaaagtaatttatagcaagc

SEQ ID NO: 5747 - DNA, 339 bp, Methanobrevibacter ruminantium
aaagattcctcaaaaaagattagaataaattaatccttagttttaaaaaaataaataataaaatttgtactatataatttatattcataatattttatatactttaagaaaaattaattgaattaagacaatattttaaagatttagaaccaacacttaaaaaattttataaaaaataaaagataaagtaagattatctaaataagattttgattaaactttttctaaaagtttaaaataattattatctaataagatttaagaaaagaattttgatcaaactttttctaaaagtttggaattttaatcaggcttttctaaaagtttgaaggtgataga

SEQ ID NO: 5748 - DNA, 163 bp, Methanobrevibacter ruminantium
agctttagaagttcaagtttaacaaggttaaaatcgattatttgtactttaaataaagatcaaataagattttaactttatacctattttaatgattaatatgacaaataagctaatagaaaaacgacgagagagaaaaagacttaaaaagatagtggataat

SEQ ID NO: 5749 - DNA, 377 bp, Methanobrevibacter ruminantium
gctggtttaaaagtctaaaataatttagaatcctttaatgattctaaaataacttaaattaaatcattaagcaaaaatgcctaagatgacttaaattaaatcattttagacaaaaatcctaaaattaattatttaatacacctaatatttcactgctttaaacatttatttttaagaacctataaaaataatgaaattttttattatattaaaagtctaaaaaactctaattttaacaataattaaataagataaaaaataaacttataatattataatgtatccaaattatgattcatagacccatataattttaaagataccttattaatcataaaacttattaaaattctttaaaataaaaaactggtgaaaaa

SEQ ID NO: 5750 - DNA, 191 bp, Methanobrevibacter ruminantium
gttgattaatttcaacttatctttttctttttttaaaaaaaatcgatttaaaaataaacaatcaatcgtattttaaaaatcagttaaaaataaaaacaagctatttttctttttaataaattaattagtttatgtatgggccctatattttataagcaaaaatcatattttatttaataaagagagatata

SEQ ID NO: 5751 - DNA, 270 bp, Methanobrevibacter ruminantium
tctttccattctttttttttactgtacgatatgcactaagattttattattacttttttaagcaagtgaattaaattccaatcaattacttaactatatattagattaaaatcataaattataattgtataaataattactatattaagaaattgattgtatttttgatttttaattagatttttcataatattgtaatatttaagaataattattgaaaataatgattattactttaattaattttttccttgattggaggatataaaa

SEQ ID NO: 5752 - DNA, 22 bp, Methanobrevibacter ruminantium
ataataatttttaaaaggactt

SEQ ID NO: 5753 - DNA, 126 bp, Methanobrevibacter ruminantium
tattttttttaaatgattatttttatctcatcatataagaatagtttttatacaaacaaacaatatttaattaaaaaattatcctataggaattaatcaataaattaaaccaaaaaaggtgaaaat

SEQ ID NO: 5754 - DNA, 3 bp, Methanobrevibacter ruminantium
tta

SEQ ID NO: 5755 - DNA, 106 bp, Methanobrevibacter ruminantium
tttattaaaaagtctaaaaataagctaaaaaaactaaataagcaaaaatttttattaaaaatttattaaaaagtctaaaaataagttaaaaaacaaaacaagcaaa

SEQ ID NO: 5756 - DNA, 162 bp, Methanobrevibacter ruminantium
actaacaccagattgataaattgaaatatatttaaaggaaaaattcgaaaattttccataaagtttgctattgattatattataatatgtatatttatttccattatcatatataattgttttagtttaatcgaaaacaagttcgtatatatagaaataatt

SEQ ID NO: 5757 - DNA, 9 bp, Methanobrevibacter ruminantium
aataaaaaa

SEQ ID NO: 5758 - DNA, 15 bp, Methanobrevibacter ruminantium
taattatattttgat

SEQ ID NO: 5759 - DNA, 389 bp, Methanobrevibacter ruminantium
aaactaagtttatcataccgtggctatctagtttaaaactagatatagatagaatagagaaatagatttgatttggctaaaagtgaatgcaagactgcaaacaaactaaatatttgatttaagctaatttactttgattaaacttatttgatttgattaagataatttatgatacaatcaaagtcaaactaaagcttaactatattaagctaattaaatggggtaggggttaagctaaatgatataagcttgaaaacaatcccaatataacgttaatgaattgtctaaaatcaaatttcaactttaaaaaccaaataaatgcaaataaatccgattaatctattgtatttatatctagttttaattctggcttaaaaattatagaataa

SEQ ID NO: 5760 - DNA, 86 bp, Methanobrevibacter ruminantium
acaacgaataggaaaaaataatctttattgaatattttcaaatagaacttttctaaatcaatttaatggaaaaaataaaaaaaact

SEQ ID NO: 5761 - DNA, 72 bp, Methanobrevibacter ruminantium
aaaaataaaaatatttattgcaatagcaaatagaattaaaacagtcatacgggaataaggattaatgataaa

SEQ ID NO: 5762 - DNA, 354 bp, Methanobrevibacter ruminantium
atttgatgtttaaacaagaccatctgatgttcaaacaatgatatctggtgtttaaacaagaatatctaatgtttaaacaagaatatctaatgtttaaacaagaatatctaatgtttaaacaaggatatatgttcgtatatgataaaacatatttaactaaaaatttatataataattccaatttatattaaataagataattaagttaatcatgcttaattaaaacattaaaaaaagaaatcttattaaattgaagaaattttaatcaagctttttctaaagttagaatataagtataatagaaaaaaattttgatcaaactttttccaaaagtttgaaagtttgagtgataga

SEQ ID NO: 5763 - DNA, 417 bp, Methanobrevibacter ruminantium
aaataaaataatcgaaaatcactaaaagaacattgattaaaatgaatcgataggttataattaaaaaatcaaattaagccctaattataatctgatttaaatgaaaaattctattcttatttaatttaacaaataacatcatcatatcaataataagaagataatttatcttctaatacttttttttaaaattgatttttattacgatttataatataaattcatatcaagtaataatctcacctatgactaaaaaaataattccttacgtagcaaatccaaattaaataatttattccgattaaaaattttatagaacaaaataaataagtttaataaagaaaaagaatatatgtatatatcagtatagtataattttataaggtaatagctaataaggtaaaaagggacgataat

SEQ ID NO: 5764 - DNA, 217 bp, Methanobrevibacter ruminantium
ttgcaataatttttatttaatttctaaaagattttaaacaacaataatctttcatattaatagaattaatttaaatagatataatttaattttttacagatttttattcacaggtgatattattttaaaaatagaagttgctgaggacaaatgcacagcatgtggaaactgcaaggaaatttgtcccaaaggtggatatatttggaccattgatact

SEQ ID NO: 5765 - DNA, 157 bp, Methanobrevibacter ruminantium
ataattaatcgtgaaattaattaaattatagtttaatttttttgtgaaaattgattttgatctactattaaatataggttaatttttttaaaaaaattaatcccatttgctattaaatttttaaaaaaaattcgtcataaatttaatctttttagct

SEQ ID NO: 5766 - DNA, 257 bp, Methanobrevibacter ruminantium
ttgaccaaaaattttttttattttactctctttttactctttattactctttttaattttatttaattcttatttttttttaaatctatttttcataacactttattttattaagttatttagcaaacttattgtaattaaacgattttttacttattttttaaagacaggccctttataaaaatttataaagtcttaatgtaacacaaaacatttacataacacaaaaactgttagacattttcattaattgaaat

SEQ ID NO: 5767 - DNA, 34 bp, Methanobrevibacter ruminantium
atcactcccaattaaaaataaatataagtgttgt

SEQ ID NO: 5768 - DNA, 35 bp, Methanobrevibacter ruminantium
atatagaaaaaatatttataaaaaaaataaagcaa

SEQ ID NO: 5769 - DNA, 424 bp, Methanobrevibacter ruminantium
attaaaaactttgagacttttagtatttattttttaattgtcttttcactactttgaaaaattattccatcactttttataaaattaaaaaaatcatttatatattcattcaaaaaattgaatgaacctttataaaaacttattcaaaaaattgaataaacctttataaatacctattcaaataattgaataaacctttataaaaacttattcaaaaaattgaatgaacctttaaaaatacctattcaaataattgaataagataaataattaaaaaaagttcgaaataatacgaataaaactatgggctaaaaaataggattattgggataaaaaaatgaaaaaaagtaaattttgatttttgatttgagatttgatttttgatttgatttgaattgtttttaaaaaaagaaaaaagaaaaaa

SEQ ID NO: 5770 - DNA, 10 bp, Methanobrevibacter ruminantium
atcaagacac

SEQ ID NO: 5771 - DNA, 322 bp, Methanobrevibacter ruminantium
aatatcacacatatatgtttagtctagatattaatagataatatcacaatactatgtttagtttttagttattaaatagtttagggaaaaaattaaatcaaaacttttatataatagaaaaattttttaaaatttaataaaaaaatagaataaggtaataatactgttttatatgaattaaactaattatacggagatatctgttaaaaaaagcatatgataagaagatattaatcaatcaaaaaaataatagctctgaaatgaaaaatataaggcctaaacaagccctgaaaacaagaaaacagcaaacaaaaaacattga

SEQ ID NO: 5772 - DNA, 146 bp, Methanobrevibacter ruminantium
acttttctatcgtttaatacaacaattaattttaaattgataataatatttaaaattttttaacaaaggataagtattattaggacaaataaaatataagatattaaaagaactgaataaatttaaacttttaaaacgtgattaaa

SEQ ID NO: 5773 - DNA, 103 bp, Methanobrevibacter ruminantium
atctaaaaagaagaaaatttaaaaaagaattaaaaatttaaaaaagaattaaatatttaaaaagaagaaaatcaataaaaaaaattagaatttagaggataag

SEQ ID NO: 5774 - DNA, 53 bp, Methanobrevibacter ruminantium
caatcaagcctcccaaaatagacttaaccctaaggaaaataaaatccatcaaa

SEQ ID NO: 5775 - DNA, 144 bp, Methanobrevibacter ruminantium
tactataaatagtaatccattttatatgagaaatatgaaaaaaaaccgacccataataataaaaagatccatgaaataaaaaaatagagcaaaatatgaaaaaatgaaaaaaataaaaaaataaaaaaagaagaaaatgaaaaa

SEQ ID NO: 5776 - DNA, 162 bp, Methanobrevibacter ruminantium
atacgtgttttacttaagtacgcgtttatccttaagtaggcgttatcttaaaaaattcgaaatcaaatggtaaataaaataggaattgaattattcaataagaattaataatcatatgattgattaaaacttattaaatataaacaattcctaataacgtgt

SEQ ID NO: 5777 - DNA, 104 bp, Methanobrevibacter ruminantium
acaatcacccttgttaaaatagatattctgcaaaaaattgaaatttttataatcaatggcttcatataactaaacacaaaaattcatattttgcaaatcaaaaa

SEQ ID NO: 5778 - DNA, 1175 bp, Methanobrevibacter ruminantium
caaaaacatgaaacaccagaaaaaatcacaatgccccaaaaaacatgaaacaccagaaaaaatcacaatgccccaaaaaacatgaaacaccagaaaaaatcacaatgccccaaaaaacatgaaacaccagaaaaaatcacaatgccccaaaaaacatgaaacaccgaaaaacaaatgttcgaaaatttgaaaataaaaatattcctgaattttttacataaatatcctcttccaaaaaaataattgttatacttgaattcgtgtataattttctttatcaataattaaataaattaattataagataactacattaaacatttttatttaaagttatatttaaatcttatgaaaatgcttatttttgaaaataaagaaaaaataaatctaaaatgaaaaaaataaaggctaaaactaaaaaaaaatacaatatacaatagaaaatatacattagataataaaaagtatacaatagaaaaaaggcatgtgtaaatttgtatgtagataatactttcttggaaaatttaaaatttttaagggaaatcagactatttttatgaaaaaaattttagaaattttaaaacttctccagaagatctatgaaaaaacgcaggaataatacaaaaaatatataaaaatgatgataatatcattttttatacaaatatttttatcaatgagatggcttttttgaggagttgtaaaaaagatgaaatgataatgaaatgaaattacctgatttgaaatgatattatcatataattttcaaaattgaatttaaagttattttttacacttgaaatatatgtcaagtaaaatcaaaaagttaacgaatcatagaatgacattaacacaataactctttttacagttgaaatatatgtctaagagttacagaatagatattgaaagactctaatattgtatgatgttaaaaataatatgaaatgattatgaaatgagttgtctggattataaatgacattatcaatatatttaaaaaaaaaaaaaagtatttctaaagtaagatcatgaaaaaattaaaaaaagtaaaaaaataaaaaaaataaaagaagttccaaaagaaaacctttcattaatctaaatgaaaagtatcaaatggaaattcatttatctatagggtgtccgccaaaataaaattttgacaacaccag

SEQ ID NO: 5779 - DNA, 312 bp, Methanobrevibacter ruminantium
aatattaaccctttgttgatattatttatgtttaaagtagtatataaagtttactataatattattgctttatttcatatttaaagaataattaacaagtaaaaaattttttcaaggtgcaagcaccaaaattaaaagaaaacaatagaaaaaacatcgaattttaaaaaaataactaaaataaataacttaaaaaattgaaaattttaaacttttttaaaaaaatagctttttggcggaccctctataaaaaaaaaaaaaattaagaaatagaaattcatttatctatagaagaattatcaaatagaaaaa

SEQ ID NO: 5780 - DNA, 74 bp, Methanobrevibacter ruminantium
aataattccttcaggatataaaatataatctggataaatataatgctaataataaaatatcaaatataataaat

SEQ ID NO: 5781 - DNA, 218 bp, Methanobrevibacter ruminantium
ttttcaatatttaatattttattgacttaataaactctatataatatatatgataactcattgcatataaacttgccttaaaaataagatacaaaagaaaaattgaatgtaaattgaaaaaaagatagatttgggaaaataaaaaatattttttgtgaaaaaaatttgataatatcatgggaaatttccgtagattttttagagttaacaagaaaaaa

SEQ ID NO: 5782 - DNA, 562 bp, Methanobrevibacter ruminantium
acaaaaaattaaaaaaagttatatttcaagtgtaaaaattgtagttgaaaactttaaaaaaaataactctcgaaaaattattgtagaaaaatgataatgtcagtagaaaaaatctataagataagcctaaagaataaaaatttgatgggtaatactttttaagaaagaccctgattttaatcataaaattttatacaataatgcataaaaatgtgcatgtaatatcaaagagttgaatgataatgcagattagatgcaaaataacatcattgagttagcatagaaaaaagaatatgctaaattaatatcactgaataaattaaaataaatctttattaaaaaaatagctaaaaaaactcaattttaagaaaaaaataaaaaaatataaagatttaaaaaaaatcaaaaataaggaatatgaaacttagagatctcagtcattataaaatctatgctgaagatattataaaatcatacagaaattttttaaaatctgatgaaaaagataggaattaaccaggaatatgctaattttataacaaaaatatactgaaaaagtata

SEQ ID NO: 5783 - DNA, 75 bp, Methanobrevibacter ruminantium
aggatgtataaaaaatctaatgaataaatataaatcgaaaaaatatatttaaaaaaaattaataaacgaaaaata

SEQ ID NO: 5784 - DNA, 241 bp, Methanobrevibacter ruminantium
attattagattatttaagattttatataaaagtttcttttatattgggagaaaatgattaaaaaagaatagataggtaaaaataaataatacttattagttaaatctgaaaaaagagtaataataaagattttaacaatgattgatataaaaaaaattattatatgaaagcaaaaaagactctaaagacggtttactatatgaaataaatagtaaaccaagtaaaagtaaaaaataaaaaa

SEQ ID NO: 5785 - DNA, 64 bp, Methanobrevibacter ruminantium
atgagaacaataaagaaaatgaatggaaattaaataaaaaaataaattatattggagaaccacc

SEQ ID NO: 5786 - DNA, 81 bp, Methanobrevibacter ruminantium
attaaaattagagagttaaaaatagtaaatcgtttagaaataaaaaaaaatagattaaaaaaagaaaagaaaaagaaattt

SEQ ID NO: 5787 - DNA, 83 bp, Methanobrevibacter ruminantium
atttatccctcatccaatcattcgaataatatactttaatgataaaactagaaccaattagatatcagaaaaatgcaataaac

SEQ ID NO: 5788 - DNA, 536 bp, Methanobrevibacter ruminantium
aatgtacctccttttacttgcatttgtacttgattaattaagttttattttagattttaaagtatataaatctttcttttttgatataaagacagtattagagcaaaattgacttaatctcttaaaattgatgtaatatcgtaaaattgacttcatttcgtaaaattgatgtcatcgtgtgaaagttgtatgaaaatgtgaaattgatgtcatcgtgtgaaattgacttgaaagtgtaaaagttgtatgaaactgtgaaattgacttgagaatgtgaaagttgtatgaaactggaaaacacaattagaaccaatgcaacaataaaataaaggctaaaaatcaatataaaaaattaatcttcaaaaatgaatataaaaaaaagatataaaatataaaaaataaaactaaaagcaagcataaaaacaattaaaaattagaaaaactaaaacataaagattaaaaaaaatgaagaaaaataattatcagaattatcaaaacaaatcatatttatcaatcataatcaagttggggataag

SEQ ID NO: 5789 - DNA, 108 bp, Methanobrevibacter ruminantium
gtctcaaatcctatttaaaaaagaaaattcagtcaattagaaaaagaaaaagttcaaatcttaatttaataagattaatccaaatccaattttagtaaaagtgattag

SEQ ID NO: 5790 - DNA, 159 bp, Methanobrevibacter ruminantium
ttgtaaaaaatagtgactttttttctatgaaataaacaagattaaaaaaaattctagtgattgaaaattattaaattaaaaattagtttaaactgaataaattgagttatgaaaattcaaaaattatagattagttcaagcatagattagataaaattt

SEQ ID NO: 5791 - DNA, 5 bp, Methanobrevibacter ruminantium
ttgat

SEQ ID NO: 5792 - DNA, 613 bp, Methanobrevibacter ruminantium
ataaagtcctcttttgataataaaaaataaaaactgatctttgaaaaaaatattctacaataaatatctaagtatgtaaaaattttataaatatattattattttaatccattataaattttatttaatttcaagattttgaaaataactgatattaataacgaagagattgtttgagttataagttataagttataagtgaaaatattttaaaaatttatgaaaaaaacaggaaaattaaagatacagagattttttgaaaatatacaactataaaaattgaacttattttgaaaaaataagaattaaaaatgtcaaatttaattagtctcaaagatgaaaaaaaaattattttgtagaatagaaaaaaaatctaatgaaattatttttttatctacttaaagaaaaaaatcatcaaaaaatatacaaaaagtatattatatttttagaaaaaagtgacatggaattaatgaaaagttactgtagaatttaaaaaaatgatgaaaaagtgaaaaaaataatctgaaaaaataaggccaaattatggttaaaataaaaaaaataagaatggaaaaatagttttaattgtatactgtaaaacggcttttaaaaa

SEQ ID NO: 5793 - DNA, 246 bp, Methanobrevibacter ruminantium
atcaagatatttgttagtgaaaatatttaaattgattgaaataagaagggatgttttattgatataagttataagttataagttttaatccatatttagacctaaacttataagttttaatctatatttagaccaaaagttacaatttttaatccatatttagaccaaaaatctgcaattttaggcatatttttgataaaaattcagaattttgaataataagttataagttataatgtataattt

SEQ ID NO: 5794 - DNA, 124 bp, Methanobrevibacter ruminantium
attaatagtacagaatgtttataattaaaaaataatgtttatttaattaattttcattcggatttcggacttataaaaataacaacaaagtaaaaaaaaaaaaaaaaaaaattaaagtgataaa

SEQ ID NO: 5795 - DNA, 54 bp, Methanobrevibacter ruminantium
cttttctttttttttttttcattttaaaacctttttctctttattttataacct

SEQ ID NO: 5796 - DNA, 320 bp, Methanobrevibacter ruminantium
atatttataacaaaaaacttataaattaaaaattataaataataagttgtaagaaataacttaaaacttatatagtataagttataaattataatatataagttaaaaattattcttaataagttataaaaaataagtaaaaactaagaagttttaccttaaaaattcaaagaaataagttaaaaaaaataagtaaaaagttacaacttttaccttaaaaattcaaagaaataacttataaattataataataaacattagagaaaataagtattttacactaaaccacttatttttaaaaaaaacgaaggagtaccaac

SEQ ID NO: 5797 - DNA, 91 bp, Methanobrevibacter ruminantium
ataaaataatgatgctgaaaagcatcaaaaaatcataatcattaatttatttaaaaacaaaaaaatcttaaaaaaatcataggggataatt

SEQ ID NO: 5798 - DNA, 366 bp, Methanobrevibacter ruminantium
ttatccacttaacatcaataaatcgttgataggtattgggtttatattttaaatataaattctttatctatcaataatttaatatctattttctatctatctatcttctatctatcttcaatctatacatcatatatctatctatacctatccctatgataagcactatataaaaacaccactaaataaaccatatcccccccatctataattaaaaattctaattttaaagcaaagccctaaagaacttaatatatttttatatatcttgaaaaataaagtcttaaataattattgagatttcttattttaataaagatgaatataggaatcttaaataaaaagataggaataggggatttttaa

SEQ ID NO: 5799 - DNA, 197 bp, Methanobrevibacter ruminantium
gtaatttgattgtttttgaaaataaaaataggagagtactatttcaagtgtaaaattctataaaaaagaaccaagcatccaagtaaaaatttaattataaaagaagcataataactaatattcagtaaaaacaagcaaaataaaaagtagaacagcccatgctttaatgtcaggttaaagcatagccgaaataaaaa

SEQ ID NO: 5800 - DNA, 5 bp, Methanobrevibacter ruminantium
ttgag

SEQ ID NO: 5801 - DNA, 842 bp, Methanobrevibacter ruminantium
cctcgttttgaaatagaagttgaatttctattcgattaaatctctaaatgttttttattcttttagaaaagaaagttttattctaaaatataatttaaagttagtagtatataaattttgaataaaagcaattacaatattagaaaagataggatattgattaaatttgatattatgagtaaaataaataattaaaaatagtaaaataagcttatagattatttcatattatataaatagtttatatttcggcgaatgatgaattaggtttaactttttaatctaagtcttaaaacattccagattatgctaaataaaatccaattttcttataaattaaatttcaaagtttagaatagtgtatttataaaatgattagcataaaaataattaatagactaaagtttcacctatgctttaatttaaaaaatatagaaaaatattttgacatctattgaaaaaagaaataaaaaatatgcttaaaaataaaaattaaaaataaataagtgtcagatagtaaatttcttaagttaaaatctttctataagaatccatgataaaaattaattattgaaaagataaaaataaaaaataagaaaaaatagataaaaaaacattaattaaaaagcctaaaaaacataaaaaataagaaaaaatagataaaaaaacattaattaaaaagcctaaaaaacataaaaaataagaaaaaatagataaaaaaacattttttaaggcttataaaaaacaaataagaattaaagagaaaaaaacattattgaataatgcttaataaaagacttaataaaaacaaaaacaattaaattacagaaacaagtgaaatt

SEQ ID NO: 5802 - DNA, 166 bp, Methanobrevibacter ruminantium
aaaccgcccatattaaaccacaagaaaaaaatcataaaataattttaatgtattattactattcggttgtaatgttctgttcatttccaattctatagcattaaaagagtttattcattcatataaacccttttccaaatatacagcaccccaagagtttattcat

SEQ ID NO: 5803 - DNA, 236 bp, Methanobrevibacter ruminantium
agctacggacgcaacaaatatgtttaggctttactttcatgcaagccacctaccgttgccattgattcattttaaagggattaaatcgcatataaaattaaaacattagttgtagtacataaacctctttaaagaaggtactataacaaaatttaaaagacaattacttgtccactaaaaattaaagaaaagatattttttaaataaatgcctatatcaaaaggggaaattaatga

SEQ ID NO: 5804 - DNA, 23 bp, Methanobrevibacter ruminantium
aaaataaacctaaattataaaaa

SEQ ID NO: 5805 - DNA, 1109 bp, Methanobrevibacter ruminantium
atattgtttttaagttctaatgccttatcacattcacaatctaattccaatgccttatcaatgaaaattaaagcatctgtataatttccttctttaaaaagaatcattgatttaaggcaatagttcttagcagattcctctttttcaattaggcaatcacagattttattagcttcatcaaatctatccaatttagaaaggattaacgatttataccaataataagcatgagaaaattcctttttgtcatcaaaattaggatttttaaaaaatttatctaatgcaatatcaatatttttcaaagccaatgaataatctccttttttatattctatttttgaaaggagataataatttccaaaatcatccatggaattatattctttgcatatttctagagcctcatcatagtcagacaaagcataataaagcctagcctttgtatctattaattgaaggttgtttggatataaatttaaaccttcattaattaatgccaatgcttcatcaaaatgattaagactaattaatatggaagatttaagagaaatggctttttcattatttggattatgtgccaaaatataattcacattatttaaggcatctctactgcgaccgatttcagataaaacataagatttgaaaagacggacctcaataatatctgcattatccaatatgatattgcataaatctatgaaaatttttgtatgaattcctttatcaaataaagaaggatggcttgcataatatgtcatttcattattcattttatccaaatcgaaattaatggatgcctccttataagaatttaaagaattttcataatcatttaaattgcaataaacccttccttttaacaggaatgcatcaatgcaataatctatgctgagcagatgatccaatacagataaagatttctcgtattcacctttattatataaaatcaaggcttttttatatagtgcacctaaattattttcatctaaaattaaaatattattaagaataatcaaagctttatcaaaattttgattatttaatgcagaatctaattctttaaaaagtttattaatttttatttttgtaaacataatatcctccaa

SEQ ID NO: 5806 - DNA, 399 bp, Methanobrevibacter ruminantium
agaagcattaataacatcataaagataaattccagcaaatgaattaaagatcttagaattgctaatgccaaatgcattccctgtggaaaatactgcatttgaagatgcagttccatatatgcttaaatttttttaagcaatttcagaatagaaaaaattataaaaatagaaaagtgccatcattgcaaaaataccaaatattatttaagcatggaaaaataaacttaatatattatagaaaatataaacttttaggccaagtcagtgaaaacttaaaggattagtttaaaaataaagaaaatttataataaactgaatcaattaaggcacgaaaccttattaaactactaaatttaggtcttaaaagttattacacttactaaattattaatattctaa

SEQ ID NO: 5807 - DNA, 110 bp, Methanobrevibacter ruminantium
attaatttaaaaaataatagcgaaagctattattcacctttcttattttcttgacaaacgaaaaaataatattcattttacaaaattgtttcttttttttagtgatttaa

SEQ ID NO: 5808 - DNA, 10 bp, Methanobrevibacter ruminantium
ggggaaaact

SEQ ID NO: 5809 - DNA, 59 bp, Methanobrevibacter ruminantium
ctcttaaaaaaaaaattaaaataagataaaaaaagaaaaaaactcataaaataaaaaaa

SEQ ID NO: 5810 - DNA, 55 bp, Methanobrevibacter ruminantium
tcaataataagataaaaaaagattaaagtctataataaaaatagtaaaaggaagg

SEQ ID NO: 5811 - DNA, 118 bp, Methanobrevibacter ruminantium
gattcaccccctaaataaaaagaactataataaaataaaaaaatatataaaagacaattaattataaaatataaaaaaaattaaaagtacattaattataatttaataataagaataa

SEQ ID NO: 5812 - DNA, 57 bp, Methanobrevibacter ruminantium
ctaaattgtaatcataattattctaaactataagtaaatcaccaaatcaatacatca

SEQ ID NO: 5813 - DNA, 127 bp, Methanobrevibacter ruminantium
tttttcacctctttgattcgatagacaaatattgggatataggtttttttaattgatttattttaataaatttcacttcaagaaaaaaacaatatccattataatattctatatttgtttttaggaa

SEQ ID NO: 5814 - DNA, 95 bp, Methanobrevibacter ruminantium
agaagcaatataagaaaaattttaaaaaaaaaaatagtaagcaaaaaagcaaattctaaaaaaaagtgattaaataaataaaaaaataaaaaaaa

SEQ ID NO: 5815 - DNA, 22 bp, Methanobrevibacter ruminantium
ttttaattgggctaatgattat

SEQ ID NO: 5816 - DNA, 26 bp, Methanobrevibacter ruminantium
gaagaaaacacctgtgaatatagcgg

SEQ ID NO: 5817 - DNA, 285 bp, Methanobrevibacter ruminantium
aaaacacctcataaaagaaattttaatttatataaaatatgaattaaaaatttctcttaatattatttattagattaagtatttattaaatttttgataaaagtattactttttttcatatttttcaggatgatttttgaaatttcatttctccagcctatgacgaatcttcaaattttttagtttgcatttttaaattttttaataacagatacgaatttgcaaatttaaaatttatcttcaaacttaaaattttctatgaacttatcttcataaaatccttaa

SEQ ID NO: 5818 - DNA, 558 bp, Methanobrevibacter ruminantium
ataaaaatcataaaaatcacaagaaaagatcatataatttcatagaatctgcaatgattctaataaaaatgaactaaaacttgaaatagttaattaattttgaagaatattaagaaaaaaatacacaaatttgttaggttgtatagaaataataataagatttatatttattaagttaaaaataaatatgcttatatgaaaactatagcgaatatagtgagtatgtaggcgtatgaaaattttgttataaaatagtattaaaaaaattttgaaattaaatggaagatatttatcctttatttttatatacctgttaaattaggtccattattaatgggtagaataaaaagggggataaatgtagtttcaactacattaaataacttaaataactattttctatataagattccttctttatagaaatgatttaatcatatcagctgttttcaatggttgataatagttatttattttatttaattatttcaaaatttatttttgtctttttttaaaatcataactctgatctttttttattgaatattattcattttc

SEQ ID NO: 5819 - DNA, 404 bp, Methanobrevibacter ruminantium
aataataataagatttataagtatataataataaataattgagtacaagtacactttgataagttatatattgaagttgatactttgtaccctttcatttatttcttttttttactatatatttgatatgtaccagtcaaatatgccaaaaggaaaaggtactgcgtaccgtttcaataatttttttaattaagatgaggatttacactttaataagacttttcaattattaaaggagtatattatatgcactttaataacacttttcgattattagagaggtaaagagacatcgcgaattttataattaattttataattaattttataattacatactaattttagcaaaactttcattgtactatagttaaacaaaattttcttagttttaaaaattaaga

SEQ ID NO: 5820 - DNA, 13 bp, Methanobrevibacter ruminantium
acacattttttaa

SEQ ID NO: 5821 - DNA, 896 bp, Methanobrevibacter ruminantium
tttttaaattttttttaaaaaactaattttaataaaactaaattttactaatcttaataacttaactaattttaataaaactaaattttactaatcttaataacttaactaattttaataaaataattttactaatcttataactgaactaattttcattttcagtaatttttaatagaatttttactcacattaaaaactaattttttaacgattttaaaaagaattttatattaatgattaaacaatttattaaactcagataacttgcatctaatttattttgaagttgattattttgatggtaatttaagaatatgtataaaataaaaatagctacttttaatttaattgatttatatattcaaatattatttttcaaaatattacatataccataaatggtagaaagagctcaaaaagtgaaaaaattagaaattgaaaaaaatttaaaattcgatgaattaacattataaaaaaaattaatgaaattatgattgaaggaataataaaattttatctaaaaaattaatgaaattatgattgaaggaataaaaaaattttatctaaaaaattaatgaaattatgattgaaggaataaaaaaattttatctaaaaaattaatgaaattatgaaattaaaaaattataaatatagacagaattataaaattattaaggtaaaaattaatagaattatattatttttataatcttaaatttttttaacttaatttaaaactaatttataacttaattaataacttaatatataacttaaatttcaatgaaaaaatgaagataatagatgatttactttataatctaaaactttgattaaaataggaatttaaaaaatatattttggattaaattttacgaggaggaaaaacaaac

SEQ ID NO: 5822 - DNA, 2 bp, Methanobrevibacter ruminantium
gt

SEQ ID NO: 5823 - DNA, 155 bp, Methanobrevibacter ruminantium
atttacttataaaagagcctagatttaatttataatttttaaaaacataaaaaggagggataaatatgcaataagtgaaaaataatagttttcttaaatttcttgttttcagtttataaaaaaatttaaataatgttcaatacataaactttacc

SEQ ID NO: 5824 - DNA, 138 bp, Methanobrevibacter ruminantium
gaaaataataatataggcttggataagtctagcgattgctcccctatctccttagaaaggtaaaaaaaggaatatatataaattttcttgatatgataagatttttgatatgataagaaaaagtatatgaataaaaaa

SEQ ID NO: 5825 - DNA, 709 bp, Methanobrevibacter ruminantium
ttaatcactgaacctttcttttaagtataaatctttttaaataaagcatgatgataattctaaaataaatatcatgagtaaattaataataaatccaaatatcctaaatagattaattataaaactaaatatcccaaatagattaaaaataaatccaaatatccataataaattaataatttttataaaacaaaatctttactaaattaagcatgaaggatacagtcaaatattatatttgtttctttttaaatatataaataagcatttttaaatttaaaatactttttctaaatctttttccattttaataaggaattaaattaaaattctattcaattttattgtaaattagttaattttaagatgcacttcatttaggctatatttacaaaataaattaagaaataaagttaaattatttatataaaatcatacttatattaaattaaatcgagtaaatagtaaaaataaaataatataaattaacaaccataaagaccaaacaaaaagcattgcaaaaagaaaaaaacatcaaaaaacaaagaccaaacaaaaagcattgcaaaaagaaaaaaacatcaaaaaacaaagaccaaacaaaaagcattgcaaaaagaaaaaaacatcaaaaaacaaagaccaaacaaaaagcattgcataatgattaaaaaacgtccccattaagatttaattatggagaattgaa

SEQ ID NO: 5826 - DNA, 132 bp, Methanobrevibacter ruminantium
taagaagttttattaaaataaataaaatgcaaaaataaataaaatgcaatattgcaataattattaaaagatatgaataaagagaatgttaaaaacctaaaaaagaattaaaaagcgtttaaaggtgtttat

SEQ ID NO: 5827 - DNA, 138 bp, Methanobrevibacter ruminantium
taatccattattagggcagaactaaataaaacatccgaatcccttacttaatcaaaagactttaaatagtaaaataaaattatttggcaataatcaataaaaaaaattagttaataatccaaaataataattaataaa

SEQ ID NO: 5828 - DNA, 76 bp, Methanobrevibacter ruminantium
ccaaaagaaccaatattgtccataccaccaattaagacctaaaaaagagcttttaataaaatcccatgaataaata

SEQ ID NO: 5829 - DNA, 518 bp, Methanobrevibacter ruminantium
tctattgaataagtgccataatattacagttatgattgctaatgcacgcaaataatctaaatacacaattcgttttttcttaggttcttttttattttctacaatcgtcatgttatcattaaataaaaaaaatatatcgactatataaacttttataaaaatttaatcctttaaaattgctttatttttcataatataaatatatatcgattaaacttaaatctaatttgtattaatcgagttaagtcatttaaacgtaaagaaatatcaatagtaagatacttgcatttcatcatttaaagacatttttaaaaccagcaaacttttaaaataaatttgaatctaaccaagataataaataatagaatcaataaatatatttattgataaactgatagtacttaaagctaaagcaactacaaaaaatattgacaaatatccaatagaactctaagaggggaattagagaataattaaaaaaaataattctaaaacaaaataataaataaaggagaata

SEQ ID NO: 5830 - DNA, 169 bp, Methanobrevibacter ruminantium
tcttaaaatcagcaataaaattctataaaaaactatgtatgcttatttatgaaaaaaagatagaaaagagctaaaactatacatgcttattaacaaatgacagtaaaaaaaagatttgataaacaataatattgactgaaatactaaaaagaagattagagggaattaa

SEQ ID NO: 5831 - DNA, 71 bp, Methanobrevibacter ruminantium
aaaaaaaggaaagtcttgggagaaagccaaaacaattcaaggatttaaagattaaaaaaataggtgaaaga

SEQ ID NO: 5832 - DNA, 61 bp, Methanobrevibacter ruminantium
tttgaaattattagtttaattttaatcaatcaaaataaatattaaaaacaatatttattaa

SEQ ID NO: 5833 - DNA, 773 bp, Methanobrevibacter ruminantium
atcacctcatttttgataattagaattatattattaaggaggtcagaaatatattttgtatcaaaccatgcttatattaattattttctttgtttgatttatattttcatctttccttatataataattatgttttttattttatttaaaaaaaataatgccattctaatcgttaaatttattaataaacttctacatatattattttgtaccatatattattgtaaaaaatgattcacaagtttaaataggaaaagacgtccctaattataattttgatatatagatatttaaataatttgttatataatttataaaaaataatgactagaaattgtctaaaatatgaataaatttaatattttaacaattttatttagcacctataatataaagaatatttttaaatcatcaaagttttagaattttatttggaactttgtaaaagttcggatattgtttatgctgtaaatcaaaagaaattattgcaagatgaagattaaattcatttcctttggaaatagatagaatagaattaaaataatcttagaaatgatatatttagttatttgaggtttattgttgattcactcgaacatggttaaatataatccataagaaaaaaactgtattgcagattttgtttatgatgaattattaaacagtcctcaaaaacagcttttaaaaatttatagaaaaattttgacgagtaattattttaaataaaccaaaaattataatttaaatattgaaaaatttaaaaatgtgataaa

SEQ ID NO: 5834 - DNA, 167 bp, Methanobrevibacter ruminantium
ccataccgattgggaaaatgctcaattgcttgttaaagaactagaagggtaaatttaaagcccataataatatcttttaaataattaggatagttatttatttctaaaatcataaaatttaaagaaaaaatatagttgaactaaaaaatgaaaaaaagcgggataat

SEQ ID NO: 5835 - DNA, 64 bp, Methanobrevibacter ruminantium
ttaaaaaagctctaaaaaagagtaaagtgttgataaagaaaggataagaatttatctaaaagaa

SEQ ID NO: 5836 - DNA, 157 bp, Methanobrevibacter ruminantium
gttaatacctgttttttaataatttaattcagttaatttagacttcacaacaatatataaaacctaaagtctgataatatacacttcataagagcaaatatttaaaacctaaagtcagataatttagagttttttaaaattgatacaatattcatac

SEQ ID NO: 5837 - DNA, 22 bp, Methanobrevibacter ruminantium
aaaagaatatttgattttttta

SEQ ID NO: 5838 - DNA, 2 bp, Methanobrevibacter ruminantium
tt

SEQ ID NO: 5839 - DNA, 184 bp, Methanobrevibacter ruminantium
aaaagcatttttatctaaatcattgattccaaaatccttaaaactatcttgaaagtttaaccaaccagaataataaacaattacattacgattggaaattttaaataatttgttaatatattttgaaataattatttgaggctcaagttcattctttagttcaaaaaaactaggtataagtcac

SEQ ID NO: 5840 - DNA, 1005 bp, Methanobrevibacter ruminantium
attactaagatttttttaaatgggattgaaaaaacaatatctgaaatcaaaccaaggagaaatattagttaaattatacagtttcttaatatatttagaaataattgtttgaggctttatctcgtctctaatttcttttaaatcaggcataatcatcaaacatctataggttttaaagataaattttttgaccttttaaaaaaatcatactcattttctctattgtaacccttatgaattttatgaggtaattggaaatccttatatgacttccttatatcggattcattcaaattatcacctcttaaaaagaaaaaattctacagtcaatttacaaaatatgtatggctaaaaatttaaattagcccatgtaattctcaattttttcgttaattgaaaatattttcttttctaatttcttaaaagtctgctatagaatctaatctaagaattttaaagacaaatgtttagaacctttaaaaaaatcgtattgttcttccctcttttcaaaataaatttttcttttaggaacaaaagggtatctaaaaacttctagatttttagattctttcattatctcacctctttaataaaattcatctatcgaatataaaatctatttttaatttacttttaaataatatatttatttaattattgaatatcctattatataaagtttgttgaaaaaaataagtagtttacaatggtaaactatacattaaaggaagtagaatgttttaaaagataaaaatggtttacaatggtaaactatgcatgaactaataaataaagtttttgaaattaataaaaatataaaaagagattaatcattttatttgttgatgacttatttaaactaaagcaatcaagccccaaaatagcaataaattatttaagctatcaaaaaaagagaatattaaggatttaattaacttgattattataagccttagggcattctaatatatttaatctcataattttcaaaatagagggaccttt

SEQ ID NO: 5841 - DNA, 121 bp, Methanobrevibacter ruminantium
aaaagagcagttataccgccattgaatgtgactctagatgcatcaaagtataagaatgtccctgcagtgccttagtagggattgaatatttaatgcttaaagaatagctagcttaatataa

SEQ ID NO: 5842 - DNA, 96 bp, Methanobrevibacter ruminantium
tttttatctttttatcttataataattactcttttagtaatatatttgatattcttatttttttttatttaaactattaagagctttttaattatc

SEQ ID NO: 5843 - DNA, 178 bp, Methanobrevibacter ruminantium
ttataagcaccgattaatatatttcttttagaaataatataaaattattgatttttgttcaacaaatggagataataaataaagataatgattaaaaaattagaataatttaatgattacttcacatttaaagctgacaaataaatatttaaaaaaaaataggaaaatgatgaaagaa

SEQ ID NO: 5844 - DNA, 35 bp, Methanobrevibacter ruminantium
agtttcacctaaaatctcaaaatctctaaaaatct

SEQ ID NO: 5845 - DNA, 242 bp, Methanobrevibacter ruminantium
atgattcctctttgctttttgatattatatttaaaataggaaggataataattttactaaaaaagaaaagataaaatcgaaattcttaagagaaatagtgaaagaaagagaaataaattaaaacaataaaaaagagcaaatttgaatttaaaagagtaatataagttgaaaaagagttaaattaaagtttaaaaagaattgaagttaaaaaagagttaaattaaagtttaaaaagaattgaa

SEQ ID NO: 5846 - DNA, 78 bp, Methanobrevibacter ruminantium
ataatagttaatgtgttacaacttggttaaagttaataatatcttgacttaagggctaattttcaatttaccgattgg

SEQ ID NO: 5847 - DNA, 33 bp, Methanobrevibacter ruminantium
aaattattttacgattataaataaaatctataa

SEQ ID NO: 5848 - DNA, 226 bp, Methanobrevibacter ruminantium
gatgacaacaaaattgtttcaacttcacaacaattttacgaagccacgacaattttacaagataacaacaaaattgtttttatttcataacaattttacgaagccacgacaattttacgggataacaacaattttacgaagtcaaatcaactttttaagtcacaattgttatttttatccaaaaatacatagttttaaatagtatttccttgagaaagatttttta

SEQ ID NO: 5849 - DNA, 97 bp, Methanobrevibacter ruminantium
aatacggccgtgaattaaataataaaaatatggcctatagagagtgattgaaatgataaaactagttaatgagctaaaaatagaccaaaaaggctta

SEQ ID NO: 5850 - DNA, 115 bp, Methanobrevibacter ruminantium
aaaatgaaagttaaaaaaagaaagaaaaatttaattttgataaaacttttaatggaaaaatatatgtatacatgtatacaaatatacaagtattaaagtatatgagttgatttaa

SEQ ID NO: 5851 - DNA, 12 bp, Methanobrevibacter ruminantium
aaaataaaaaaa

SEQ ID NO: 5852 - DNA, 24 bp, Methanobrevibacter ruminantium
attcatgttttaaatagtcctcaa

SEQ ID NO: 5853 - DNA, 125 bp, Methanobrevibacter ruminantium
tttcatattatcacaaaaattaaaaaataaaaattaaatgttcataaatatataaaaactaataattattccttctttttaaatcttaaacagaataaaaactaagttaattatttaatggacag

SEQ ID NO: 5854 - DNA, 12 bp, Methanobrevibacter ruminantium
aggattgctcct

SEQ ID NO: 5855 - DNA, 189 bp, Methanobrevibacter ruminantium
tagacttttcaatttcggcacctcctatactcattcctgtcacctcataaaatttacatattaataagttgcaataatttaaacacttatttttcaaaaatatttaaattcattttttttcttgataaatattaattaatttcttcaataaagttatccatacttcatttgattaaagattaaaataat

SEQ ID NO: 5856 - DNA, 178 bp, Methanobrevibacter ruminantium
accacccttggatatgaaataattgattagattactctatgagtattaattttacattaaacctaattttttaaataaattgctcaatgtgaatttttaattattcaattagcgaaaataaggattaattaattattttctttcttatttattatttttattttactatattcgctaa

SEQ ID NO: 5857 - DNA, 260 bp, Methanobrevibacter ruminantium
tttaaatcactttttgaattcattttaattctaattgtttagggattaaccaaatcaaaaattttttaaatcagtaaatctcttataatattaaagttttattaattatataatttataattatcgaaaaatcatactataaaatagaaatatagattattttataaacaacaaagtagataataaatatagataaacattagagctgaataattttttatgatagaatttttaattaaaaaaacaaaagattggtattt

SEQ ID NO: 5858 - DNA, 89 bp, Methanobrevibacter ruminantium
actagaattaaataaaggtttaacagccattagtagcttatggcatttattatttattttatttttatacttattttaggatgatacaa

SEQ ID NO: 5859 - DNA, 88 bp, Methanobrevibacter ruminantium
cttaatttaaattaaataatttatcttaataagtattttttcaatatccatctaaaattatataaacattgaagtttaatattattgt

SEQ ID NO: 5860 - DNA, 251 bp, Methanobrevibacter ruminantium
tatttcatcgtcccattaactctttttctaatttcctatagattctaaattcctatcttcttttaaaaatttaattcaattatctttttttaaaaatccaatttaaaaaataagggaaaaatcgacattaaatatatatagtttaattaacataatatttaatgttaaatctatttactttatttgaataattattactattttatttttattttagaatatttttcaatagtgaatagggaggaataatt

SEQ ID NO: 5861 - DNA, 253 bp, Methanobrevibacter ruminantium
acgatttttaaaaaataacttatttaactgtcctagaggtatatttcaagtgtaaaaaattctcattttcttcaaaagaaatagtttttcaagccataaaatcaaaattagcaatattcaaaataatagaataaaactagccaaaaaaagacgtgcatttcaagtgtaaaattcgtcataaaaattaatttacaaaactttataagctatcaaaatcatactaatattactaattttatggggtgtatgtaaa

SEQ ID NO: 5862 - DNA, 155 bp, Methanobrevibacter ruminantium
tccttaatttaaaatatctttaaaatttaaccttaaagaaagaataatttattttatcattgagaaattaattgttttatcaataaaataaatattaactctatttttacttttataaactataataattcatttattaatttgggtgatatgat

SEQ ID NO: 5863 - DNA, 74 bp, Methanobrevibacter ruminantium
atttctcttttttttaaaaaaattggatttaatatgataaactcgttttagataagaataagattttttactta

SEQ ID NO: 5864 - DNA, 211 bp, Methanobrevibacter ruminantium
taaaattaaatatattaggaaactatatataatttattgataagtaaaaatttttattcatcaaaacttaaaaagaaaatataatggtgaattaaaaataaaatgaattgatcattaattgattaattcattaaataataaaaaaaaaaattatttttaaaattagacaaaatgtctaaattaatgaactaattattcaaaacgtgataat

SEQ ID NO: 5865 - DNA, 873 bp, Methanobrevibacter ruminantium
atatctttatatttttttatattcatttttttttttatttttatttttatttattttattattagcttttttttaattttgattattatctaatctatatatcgattttatatattattttatatttacattattttattaatctattattttattattaaatttatttgtttattttatttctgtttttaatatttgtttcaaatgttttttcattgattaattttgatgaaattcaaggatcttatgtttaatttgatgatattttttattgattttagtattacttttcatgtttcattcatcctggaaaaatagtgaaattttggcaattttttgtaaattttttggtgaaaattggtgatttttagagtgagagaggtatgtttccagtgaaacgcaaacgaaggtcttgaaaagttagacaggtctatttccactgtaactttttgaaattgacctctctataatttttgaaaaattttgataaaaaaccttttaaaaatgctttatttaacgatttaagctcgtaaaaatgtttattaaatttcgttaaatttttttgtttaagttttacacttgaaataaatcccttcattttcgtttcttgcatatttttatttcacttgaaacgcacctctctctcagaaaattcttttaatctataattttttggttcaaattttcatatttatcattgttttttaattttgatggtcaaattcatttattttttatttatttatgttattttttattattttttaaaaatatcatatttattttcgatttatatattttctgacttaaaaaagttttaatttttaaaaagacatcaatttcgactgtaaaattattttaaaaaatatttta

SEQ ID NO: 5866 - DNA, 352 bp, Methanobrevibacter ruminantium
cattgctagcatcaaatttaattaaaatataaatttagttgaatctatattagattttagttcattcttgggaaaaatataaatgttctgatttctggatttgttctggattttagtttgttctgagatttgttctaaattaagatctatttagatttgtttttactttgataatttatcaattaataaagaattacataagtttttataagttcattaaaaaaaactttatgataatttatgattctttatggtattttttggtactttttggtactttttggtactttttggtactttatgataactttatgattataactatactttttaagctatgtgagatgaaact

SEQ ID NO: 5867 - protein, 388 aa, Methanobrevibacter ruminantium
MTNIFEDLQEESVGVSIFKDKKPLDHRFLPENLPHRKKQITEIAKHWIEALNGNTPSNITIYGKTGTGKTAAAKFAKEQLIEASRDKNVFIKVEYIRCTDFTTEYQVLTYLCQRLGRDVPNRGWTKGEIVNTFRDILRRNAFGRNLILIVILDEIDILLEKDGDGILYTLTRTDNIAILSISNYLDFKQFIKPRVASSLRDKEIVFPPYDAEQLADILHERSELAFEENTLEESVIPLCSAMAAKEEGDARYALDLLENAGDIAVEEGSEIVKGKYVRQAKDVIEYNKVKDVIITLPTQQQRVLAAIMKLTQDNEEITSGKLFEVYKDISKGDSVTYRRIFDFINELEMLGIISTNTISRGRGKGRTNIIKLQTDSKLIQDNLSAVLY

SEQ ID NO: 5868 - protein, 234 aa, Methanobrevibacter ruminantium
MTRLIEFKNVNKEYKSGDYILKAMDNVNFTIDEGEFVVILGPSGAGKSTLLNLLGGLDSVSSGEIIVNGSHIESFDDDQLTNYRARNVGFVFQFYNLIPNLTALENIELMKDVVDFDINGLAVLDAVGLKDHADHFPAQLSGGEQQRVSIARAIAKRPSMLLCDEPTGALDSKTGALILALLQDMCEKLNTTVVIVTHNAILSEAANKVIRIKNGQIESVIVNEMPKKVSELEL

SEQ ID NO: 5869 - protein, 745 aa, Methanobrevibacter ruminantium
MKNRMILIISLFLISLLAIGAASASEDITDTIEAPAADEVVTVDSEIQEIETVDNNLEEIETDTNNIEEVEAADDEVINETAETEIKDETEITDETIISEEKVQIANDEKIVQDGLLGFSINLTDLLGGESSSLNLSKLLSGDNLNLNLSKLLSGDNLNLNWSELLSGDSFTLNWTDLLGGDSLTVNWTDLLGGESTTLNWTDLLGRDSLTVNWTDLLGEDFTLNLTDLLGRDSLTVNWTDLLGGDSLTVNWTDLLNGDSLTFNWTDLLGDNLTLNMSSLLGGESTTINWTELLGDNLTFNMSSLLGEDFNLNMTSLLGEDFKLNLTNIFGDNLTAIFGENLTNKLEELFGDDFTINMTDLFGEDLALNMSDIFGDDSIFNLSNILGESTTINWTDLLGEGSTLNISKILGESLTLNLTDLFGESSTLNWTELLGGESLTLNWTELLGGDSFTINWTDLLGNSTTINWTDLLGRDSLTVNWTDLLGGDSFTINWTDLLGGETLTINWTKILGNDTSLIDNITSLIDDISPFVDNLTTAVKDLINKFLKEEKTVSVINYEDMTTTAFDSKIDGRIGKYFVVKLTDDKGKALSDKFVQIGFNGRIYNRTSDENGTVKLQINLGYKGDYTFAICFLGDEKTNGSFAVAKITVKKQKAKLTGTAASYKASAKNKYISATFKTTAGSPIAGKKITFTINKKTYTAKTDAKGVAKVKVSITNKGTYAFTAKYAGDDTYATITSASKKLTIK

SEQ ID NO: 5870 - protein, 319 aa, Methanobrevibacter ruminantium
MYFKCKLKECNIIFGHNNVISIKDFEKEDIKFILDEAEKLEDIAQSKEKSEELSGKILGLLFYEPSTRTRLSFETAMKRLGGDCISLGETSNSSVAKGESIADTAKMFESYCDAIVIRHDLEGVSRFLSDVIDVPIINAGDGAGQHPTQTLLDLYTIRKHFGKIDGLNIALLGDLKYGRTVHSLSYALGMYDVKMTFVSPEELKMPKENLLDLEKNNIKYKETSNLKDIIDEIDVLYVTRIQKERFPDIEEYEKIKGAYLINKDLLEGKELIVMHPLPRVDEIDYDVDNTKYNKYFEQAANAIPVRMAILKNLIRHRYE

SEQ ID NO: 5871 - protein, 167 aa, Methanobrevibacter ruminantium
MKTAIIYASKTGTTKKIAKALVDKIDGEVLTIPIARAKSACLLKYDFVIIAGSIHYGRIQGEIKSFVNKNYKTLQGINYGLYITCTNQGKAEEYLNKSFSEEIVKSAFVTACFGAEINPNKGDMITKRIINSNLKRFKKENKEPPSIDWELVDEFADKINKRTIKKK

SEQ ID NO: 5872 - protein, 268 aa, Methanobrevibacter ruminantium
MKFLRFKKKINELGKDNSIKIGFYDGEKIIELKGDILDYFNSNLDEIKENMIESYSLEDIEIEAPVNPSKIICIGLNYKDHAKELNLELPKKPVIFIKPNSALNSTEKNIIFPNISKQVDYEGELAVVIGKATKKVSKEEADDYIFGYTIINDVTARDFTLGDGQWTRGKSCDGFAPIGPFIETDLDPLNQRIVTKVNGEIKQNSNTSMMIFSPQEIIEFISQTTTLNPGDIIATGTPPGVGPMDAGSTVEVSIEEIGILKNYLIKEE

SEQ ID NO: 5873 - protein, 249 aa, Methanobrevibacter ruminantium
MIFYYTGTGNSKYVAETIAKSNEEEIISIPDCIRENKFTFDVKEDEIIGFVCPIYSLGIPDSVRIFLKKLRLNYNKKPYIFLVATYGSTVGNIKSIVSKYFKKIDGFFNVKMVDNWVPKFDLTDQNYIKQAEEYGEKRLEEVNNLILLRKTGKYLENENKIFSGFIYKVGYDFIRNTSNFKLDDNCIGCGICRNNCPTNTIKIENKRPVWKRKKCDMCFACLHRCPQFAIHYGKRSIEHGQYLNPNVKL

SEQ ID NO: 5874 - protein, 287 aa, Methanobrevibacter ruminantium
MKIKIAVPSKGRISEPSIKILEKAGLGLKDSTNRKLFSSTYNENIDVMFARAADIPEFVDEGICDMGISGYDLIEEAGADVKILTDLQFGATKLVLASPENSEINTKDDLKDGMTIATEFPNLTRKYLEENNLNIKIVKLTGSTEIAPFIGIADAITDLTSTGTTLNMNHLKIVDVILESSIKLIANKNSYTEKNNLVEAVSTSIQGVLEAERKKLVMMNVAKENLCEVQKVMPAMSGPTISQVLSEEETMAVQAVVGEDEVFDLVNKLRNAGARDILVVPIERIIQ

SEQ ID NO: 5875 - protein, 67 aa, Methanobrevibacter ruminantium
MSIPVAPIGRIIKDAGAERVSEDAKKELNAYVTAQAEAVAKKAIEFAAMAKRKTVKAEDIELAIKNL

SEQ ID NO: 5876 - protein, 339 aa, Methanobrevibacter ruminantium
MGRRKKQDSTLDSYFPDSDLIEEKKKKDEACKICGNPIEDATFQRCRKCLNKLALIDDLRELLEYVSPGESFREIDLINKGFKSLKLNILISKFLKEQLILINLDGLFTLNNIDFLNAFIKKYGEKEKPLKETDYLIVRDDKSAFYIDVNNYSDYIKIRFNPRINKWQVDFFNENGLANTKSFIDSNDANKEAIYYIKQLGVIGSSADDKKEEKSDKRLYSSHEGIYYSPSRGMWGAKVKGYKGFKFIGHFSSEEEAYEARCKYLENKERTRQKYISEKRGLKSGLRNQSSGELIYFSKQKGKWIVRLKNKEGQIVNVGQFDTEEEANKAKEEFIKDNS

SEQ ID NO: 5877 - protein, 106 aa, Methanobrevibacter ruminantium
MSELKLDLVFDDYQIKRAKPARGSSVIHVNKRWIGKEVSIIPLPFDVDEKFIDETKGEDGLYHLELAVKEIFSKTVSDRKDVGFFYLKESLLGLFFLIIEAPDIVY

SEQ ID NO: 5878 - protein, 487 aa, Methanobrevibacter ruminantium
MYEKEDILIDYINNEINTVPFSLNDKLKIRNEKFRCREEFYEIKNYVDDFLEGNYTNRYIVLPGLRGLGKTTIIYQLYQYLLREKEINHNQILYISCDDLNDYMDINILDVVNCFLKLHHNSNLRTLDKKIFIFIDESQYDSNWAGAGKRIYDKTNNVFLIFTGSSALNLEYNADSARRLLKKSITPLNYGHFLKLKYGFHYDEFSDALSDLIFLGDEKKAIQCEREVYSKLYNLEGYNDNVWDDFLRNGGFPISFYEKNDDNVSQRLREVVKKVLISDIANISTISSEKYINSIRLLNFLAVQKPGDISQNKLANFLNVSPTTVKGIIDLLEKTHLIFHTEPYGSAAKRSKKSWKYFFASSSLKHALVKDLGSSMRDVKSYEGILLENLVASTFFNWTNRKNISFNLFYDANDDEKNKTTVDFIIKEGFNKPIPIEVGIGKKGDKQISKSISDYRADYGIVISNKTKFIERQGNVIYLPPRSFSFL

SEQ ID NO: 5879 - protein, 406 aa, Methanobrevibacter ruminantium
MVKMKFKRSLILAVILIILFSLGTVAASENIVIDESSDSNLVIDHAKDNYLFNGPIKDNYLSSSSISDNYLSKGVLDDSYLSRSDLDDSYLSMDDGKGSIDLTNHNQLSNSDDKQLKTSNLEDEKQLESVNKGDKLLKDSNDNVDLFINMDVKTSLTNKQYNRAGSEVPWIITVSSLNGTSYNTQVRDVLSENLQYLSHNATMGTFDPENGIWTVGDLESSKNASLTILTRLKRDGTYINKAYATTDSNDVNLLNNFLIISIRTGSSKITSNITETSDEREGIQHNVHYASMVDTDFIYRYEEDSSEDDGGNEEGQSEGNSHTKTRSLGNKLKLFNAQNIDYHSLSKNIGGALGFGYNSNGGFLNSKDIYEALFVYDYTRIPIIVFAAFLVVLASIVGYDKVKSSK

SEQ ID NO: 5880 - protein, 2004 aa, Methanobrevibacter ruminantium
MRIMINKKLFFVFLLMVLVIGTISAVSANECANDLTMEISDDNIAIDSSSALEGDDLAIDSSSSDLSNENNINSMNDSVINSNSINSDSINSDSINSDSINPNPNIDDEINNHKDSFLKAVQASKTGTFTELQTKINKASKGSTIYLDKNYLYNDDFKGKYGIVINKSITIDGKGHVIDGLKKSNLIFINDASNVVFKNIIFRKGDGDENGAINLIGSDHIEFNNCSFNYNYGDRGAVFLSGSDYSSFVNCKFNENIGENGGALILADSDYSRLVNCIFFGNEASDGGAVFITYSDYSYFFNCTSEGNSVDYTGGAFYLDYSDNSSFIDCVFDTSSAKDGGAFYLGDCHNSSFINCSYWNNQVDYYGAVCYLDNCYDSSFISCNFTGNSGSNPELDETPSIGGGVFYISESHGLYFTHCNFSENEAKNDGGAIYASDSDVHIDSSVFEENCALCGGALYAMNSDIFIDSSLFESSVGDRGGSIFANKSNVYSKNSSFIQYYEIEDEYVYIPASGAYHLMEGNIGGAIYSLQSVLNISSNKFNNNFGLTSGGDIYSQYSMIYIDDCSFSNSFSNGFGGSLSFNNDYVQITDSSFENCSSRDNGGGGIYSINSILNCSDSDFTNCYSYFGGSICSLNTDLSINNNNFYKSSAEYYGGSIYFLYGTLDINGSLFSNSYGQYGGSIYIRSPQTIKNITNNQFLFSQGIRGPRIYIDQYYGEISNSGNVYTDEYEEKGLFSDYGMGISFESNEGLVPLIHYYPSNESLPSFYDPRGGGDSEDDYEDEDDDSDIAVKDQGIGGNCWAFSGIATLEACLEKVTGEEFGFSEGNAKNLMAISSIYGLNIDTNNGGYDTMFLAYLASWLGPIYEEYDTYNPLSSLSIDLPSVFHILDIDFLAPRKNSLDNDEYKRAIMNNGAVSVTFDWVENKVSNGFHSVSIIGWDDDYDDIDSLGNYAKGAWIFKNSWGYEWGDGGFGYLSYKQKLSEEIAPYMHAYTFSFKENDIGYTDIYQYDFSGLSDFLILNSTNAYYKNKFIAEDNEFLYAFSTYFDKETDFTYSVSINGNVITKTEDGKDILTSIHHSPAGYHTIPLGYNLTLKEGDEFEIIIKLLNDNQNRIPVCQADELYRTSLPSNASFMSLNGKDWIDLSNLASSNEFSSLGIKANTSQVACIKAFTSNWRMNSDSSIVNSKNHSIITSEGTELSQYEICQLKVGSFTRASANETIIIAMSIPEWRNYQDEYENYIEVHINDEFYYVRVNEGVAYLDISFDKIGHYDFKAQFKSNIYSSDIVEFDFEVVKDSIFDVDDLDASNPGTFKELQDIIRNAKNGSIISLDKDYAFSSGDESVVDDYIEINKSLIIDGKGHIIDGSSDSGIFRLSSGDNLTLRNIKFMNADNGAIVSNGNLTVSNCYFISNCASGSSSTSTSSSDSSSTACGGAIYCEGTCFIVNSLFESNSADAGGAVYCEGTCFIVNSYFDSNYADLGGAVCCDGSCYIVNSLFDSNFAVYGGAASIVGNESCEIIDSNFIENEAIYGGAIYLESYCYLLDSSFNYNYANNGGAIYSIADLDIHTTGFNYNEAYKDGGAIYLVNSTSYINEGNFTENSAKERGGAICALEFSNLTIRWAYFMDNSASKYGSAIFSVNALNITDSEVTVSSGKVELICFAYDYASNGQAYGDLYFDENSFYISGAPEIYYFREKIAHKLALDLEFNNIELIRGGGVEISRDLNDDGWEDKINNNMLEICRLVDDDDYMTVLRMKEIEVILINKNNRSDIQKFKIPFNVKLNGYFLNTSSLKYGSYILTGNLSKDLASNCIVKNGTLKVLRKTTLSSLSTFTKVYGNSKNLVVTLKDSSGKAIVGVNIAVKLNGKTIKAKTNSKGQISIAISLKPKTYTAYISFAGNDYYASASKKVKVVVKKANPKLTASKKTFKLRNAKKYTVTLKNNLGKALKNAKVTIKVAGKTYTAKTNAKGQVTFNLKLAKIGKFKAVVSFAGNKLYNGLKKAVVLTVKK

SEQ ID NO: 5881 - protein, 185 aa, Methanobrevibacter ruminantium
MEYENILDLKSSEEFREWMIKNHSSQRECWVNCKRGKADKDELSYVDAAYVALSFGWIDSTYGLIDGKRMQRFSPRRKNSNWSQLNKERCRWLIRNGLMTDSGYESLPDLEEDFIIDSDILDELKKDNETWNNFKNFPDLYKRIRIANIQKEKDREAFDKKLANFIKDTKDNKMKGNWNDDGRLI

SEQ ID NO: 5882 - protein, 84 aa, Methanobrevibacter ruminantium
MANEIILNIDGNEHQIKYDNMEVDHVSIIDLEKLGRSLILELEIDGKVDRNSLDDAINSFLDTIYDDIKYFAVEYADDNEIELI

SEQ ID NO: 5883 - protein, 252 aa, Methanobrevibacter ruminantium
MGQDGFKNEDLMLEALNNKKFMDLNDNLKQMILDMYGEEISQDFIIKAYKKGGVNKTDLTIDINSQNFNVSIKKGTGNSVHQEKLEEFVSFLKEEYGISNVLSDDIRFFIWGDGTLDGTGEVSDRLSASEFRKQFPEKIRNIREFFYTVKRDLIERFVIKGPKSKSRPDFIYYGTPDKGIIVESQSVIDWLSDDKNEKSSSPIPIGRLTFQAWNRNINGGDKSENKRGVIQLKWSSVGKDLVKIYKEKKDDK

SEQ ID NO: 5884 - protein, 193 aa, Methanobrevibacter ruminantium
MTNRGTAEGTEEEISFVKLLNKKEDLSYWDVLNLDHNCHFAIHVLYQKFSKISNKKVYPKADVYIAKGNVPYSYLEDNDFYLSEDNTEDFDLEPIKYTGISVKLQNSSRYQITKMGPNTFKDIFGCYELGAGASIYCRDVDDLEKNPQVLTGWNTNFEDFIKYFKSFDVVSSSDLDISSYKKLKVFLIKRLRK

SEQ ID NO: 5885 - protein, 339 aa, Methanobrevibacter ruminantium
MVSKKRAMQYTLEDFKEKNLDETEENDKDFTFIDLFSGIGGFRLAFESVGGKCVFSSDIDKWANETYYMNFGEYPHGDISEIPANQIPDHDILCAGFPCQPFSIGGYRKGFCDTRGTLFFEIERILKAKKPQMFLLENVKGLTNHDKGKTFKVIKESLWNLGYSIFYQVLNSKDYGVPQNRERIFIVGFKDNVNTFKFPLPFENKANINDLLEKNVKDHELSGIASDHLKKHYEEFLKNKKVNKNYPIFATEIRPSRCSIRNDGNSPCLTAKMGTGGNNVPVLVNENRKLTVRECLRLQGFPENYKIKDNYSQSYKQIGNSVTVPVVTLIAKEMIKYLN

SEQ ID NO: 5886 - protein, 342 aa, Methanobrevibacter ruminantium
MEKPTVIDLFCGIGGFSKGFEMAGFDVLFGIDIWDIAIETFQHNHKNTEGILADLTELDDDFFKQYTNKVDVIIAGPPCQGFSMCGKREVGDKRNELFQEVVRAVKIINPKIVIIENVVGLLSMENVDGEDVKGLIVSEFEKLGYETNYKILDASEHGVPQKRKRVIFIGSRIGDVEFPKPKDKKVSVMEALGNIPDTNFEYYDEPTNSFQELMADGEKKIYNHDAMKHNEKVLKRIENVPQGGNWQDIPPEIYDVGGTHSNNYRRLDPNKPSITIKHAIKSMIIHPTFNRVITAREAARLQSIPDSFIIKGNKTAQHQQLANAVPPLLGYEIGKQIIKKLN

SEQ ID NO: 5887 - protein, 57 aa, Methanobrevibacter ruminantium
MKRIQVNFTKEQYELLQKLKGELGNSDSEVIKNITMAWLSEKSLISTTLKEKIFNNY

SEQ ID NO: 5888 - protein, 250 aa, Methanobrevibacter ruminantium
MNEIIKTTLILLLKQEIRKEQRRGIKNILLYFRDVDTLDTNSINWKIRYDRNNQNYQMIVGICYLTLKGLLQSDSKGEKKLMSFLDNQRMNRLYEKFILNYYKREHPDIKASSPKIEWQLDDDFGEMLPRMQTDITLEHKNKILIIDAKYYSSTTQTYYDKKTIHSHNLYQIFTYVKNKEVEVANEANGVELDNKVSGMLLYARTREKIYPDNDYLMSGNRISVKTLDLNQDFTLIKKQLDSIIEVYLKA

SEQ ID NO: 5889 - protein, 91 aa, Methanobrevibacter ruminantium
MDDLITTAGMYGEPVSSRKGNYIVEGLFGKPIYYIDGDIVRENNPFGKPVYRIEGNYIKEGMYGKPKYYIDGDLIRENNQFGKVVGRKRKF

SEQ ID NO: 5890 - protein, 90 aa, Methanobrevibacter ruminantium
MKYCFKCGAKLIEENQKFCIECGSNLEKRKEEHNKDLKESHKKYNPKKGESYNDYLNRIDSPIKDKIATEDEIIKESIAYKEYNPLKKRV

SEQ ID NO: 5891 - protein, 447 aa, Methanobrevibacter ruminantium
MELLDRLIPKYKDINWMKRIDIIRKTDDQALLEEIARKEEEGIVRKYAVKKINDQSVLIDIAYNDPHWESSSEAVKKIDNQDVLIDIAYSKLKASPRSKAAERIKDQNVLIDLAQNDKEYQVRRAAVKGIDDPFVLKELALNDPDSSVQMEAAKKINDGEALAEIALKDRSEFKRLEATRHIDDEKILSQIVLNDPDFYVRLEASKKITDEKTLAEMGKNDFYWQIRSNALNKITDEKVLAYMACNDPNPSTRYEAVKKINDKAILVDIALNAFDWKVRLCACRRIDDEEVMTKIVKKDTCWRIRRNAVGKITNETFLEEIAFNEPAWRVRLESIKNIEDESALIYIALNDSNWHVRRQALSKIKDKSILEDIAQNDPIFELRKLAVRMINDESVLRKIAKNDPEWKIRRLAIRNIENTDILKDIAMNDSNIDVRLAASDKITDKSD

SEQ ID NO: 5892 - protein, 638 aa, Methanobrevibacter ruminantium
MTAPDSNYETMAEMTIRNSIIENNSARNGGAILNDGNLFIEKTTFKNNLAFTAGAISNGGYVSLKDVSMENNIAVTGAAFINGGDAKIEDSFIIKNIAIGEKRGMNGEHDVGGAVGNSDNLLLKNTSFINNSSPFGSAIYNLGIDIPKLKYLCKIKIEDCRFENNSSHISGEIHNEIGEISIDDSKFKNETAKRGSVIYNDSYLTITSCDFKDLKKIVHNFNLMTIHSSNFESNQSDSAVIENDGEIGILSIEKGKIANNISDYTTVYNHGKDCNITGTIFENNHSKKENCHNICNRSNMVLKEIILKDKTVSIFNEGILTAEKKYKNFIFSVGKVFYLGMENEFNFSYLDELIHSNISDTISFDEDISLLSDEFDFYEGGIELDRDNMVIDGKGKTIDASGRSRIFLVTGNNITLKNIIFKNGHAFDNYFMSNNEGGAIKVYKGLDLKIENCKFIDNISESKGGAINNKGHLTISNGLFESNKSNEGGAIYNHQKLSIIDTCFKGNEGHIGGAIYNKEDLEIVSTKFLKNIVKESLFKARFIPILQLEDESFGGAIFNKKRMVIKQSSFKKNMGLDDTDGAWGGAIRTIGDEEVTIIQTEFIGNYLKDSNFGGAISSYKTPNLIDCTFSDNYPNDLN

SEQ ID NO: 5893 - protein, 449 aa, Methanobrevibacter ruminantium
MGMVLKINVKIGDSVKKGDVVCILEAMKMESEIFADKSGVVENILVNPGDIVNQNDLIMIIGDSIDRDENKSNKENKPKPNKEDPKDRKNEFSKSKNDKKINSPNEMLDKLKNNIKVDKILFVDGANISISPIAEAIFNKKVKGIKAYSAGLSAISGNKAVPNAIKVCENHDIDLSSHCTANIEDYDLDDSTLILSSTTYIRNILKYYYHVYKVVTINEFAGFSNLDIQDPFWSDLDAFETCFSKINDAIDEIFGLNSLEKDNMAFNCEIEENKNIQSNKEENKNTTITSNKEENKNTTITSNKEENKNTTITANKEEKNTQSNKEYLNEKSSKINSFKYLDDLIHSNKKNITLDSDIIHMEGDSPIILDVDDTLIDGRGHAIDAKGKCGIFNITGKNITIKNIVLKNGFVESDGVICNKGKVTLENISVQNNRGSKYEGNAIVNKKIS

SEQ ID NO: 5894 - protein, 411 aa, Methanobrevibacter ruminantium
MPSKIIKREAYIRDLKDYVNTDFVKVYIGIRRSGKTSLMHNIIDELKRDGVNDENIIFMSFESREYIHINNSEQLDELVYKKVENLEGKIYLFFDEIQQVKGWEKSINSYRVSIDSDIYITGSNSKLLSGELATLLTGRYLTIHVYPFSFKEFLQYKNEIEGVEITKYSIDELYEEYFNFGGMPGILSLGSDEFKRLALKDIYNSILFEDVVSRFNISNIDLLQRFSRYMISSTGEIFSSKSIKNYLKSNDIYTSEDTLLKYNEYLKQSFFISKCKCFHLKGKKEMKILGKYYLTDHGFHHALIEDNILKVTKILENIVYVELLRRGYKVNVGRNEDKTEVDFVCEKSGKYKYIQVSYRLTSEQTLNREINPLLRIPDKYESILITTENHDFSKDGVRHLNIVDFLCGDDV

SEQ ID NO: 5895 - protein, 1044 aa, Methanobrevibacter ruminantium
MSEKYTVAELKYILKENGLKVSGRKPDLVERVLPILNAEASEEAVEEVKEEVKEETVEAEIVEAEEKAPVDLTFPDTEEALSSILALYGLSYDDLSIKDIEFADGKICINGEAFIQNGLSMSDSTMSIINADPTLNLTMNIPEVAYSDFESTIFRFKDLDLNLIPTDDSLEFKAALKGLDIMTDLNNIILKGLDFAFKSFPDRGVEIGIDIDDFIYPNFYNTSFNFENLDFNMAIGVDGQSIAISVNLPALDLLNKDYRVKLSDLSLNLVLSDLQLSDLDLSIAISDFHYTNFDDVVIYMEDIGVSLEHIPDTNSFNVLIGLSAMDAVGLNSFDALFPMMEITGVNFNSKDSDSLINFTGLISPIDLTQIDLLELGALLGSGFDLDAYTRNMAYYPDIASEGASDLGIPGLDLGAIVANCDYSCLGAIELNLTGLLDSADIDLSDLGIDLSDYDISSIKLSDLIGAVGDSEFVMSAIPAVLNIFSLDLTDVDVSGLIADFDEENFDISSLLASLNLSSTDIAAILDILDKSDIDLGAIFAGCDISCLDAITLDLTGFIDSLGIDLSAFIDLSEFDLSAVSLTDIIAILNSFEFDMSTISALLKIFGLDIGDLDLEGLIASFDTENFDLSTLLASLNLSDLDIDAILAIFNNPDFDWAGIFENSDLSCLDAITLDLTGLLDSAEIDLSALGIDLSDYDLSSIKLSELIGVFGNLDFDMSDMISGIDFESIDFENIDLEGLIADFDAENFDISTLLESLNLSSTDLSAIFDMFINSDVDLGKVFEGCDYSCLDAIVLNLSGLLDSIGIDLADLGIDLSDYDLSAIKLSELIGILNGFDLDMNTLSALLKIFGIDLEELDLSGLIAIFDGDNFDMTALLSSLNLGGVDISAIVELFDNLGFDFDGMFENLDISCFDAITLDLTGLIDSTGIDLAAFGIDLSAYDLSAIKLSDLIGVVCSSEFIMSASGAVMKLFNINVDDLDFDGLIASFDAENFDISPLLESIELSGFDISEMLEMFDMNGFDLSQFLNQFISSFMENALLESGDE

SEQ ID NO: 5896 - protein, 97 aa, Methanobrevibacter ruminantium
MLKIDEFRMEMEEPKRIYTEELKKFAKKYDFLGDFTIVEERDIDTADYFFCFNNLNGTSDETLYSTRDEIYDHMIKFCEDNGIDEFSKNAYIFYKSD

SEQ ID NO: 5897 - protein, 166 aa, Methanobrevibacter ruminantium
MSQEENKMIDEVEMSSVEEIGRDSVEEIKIGSQDEIGMNSVEEMDLDSADEIDMDDVEEMEMKIENYENRIKLQDILIESLGERCEGEKERNKQLHDRIIQLNEELKKKQELEMVSDINYWRGIEKAHIELHDKYYKRIIQLEKQNFLLEVENDELKDELERIKNV

SEQ ID NO: 5898 - protein, 101 aa, Methanobrevibacter ruminantium
MTKMEFDLTDEQIEKVKELEKSGISLGEAIDLLFEIKDEAFNQMDEVDENIEIVSQITKSMNGEKKIEIIEKAYRNYEKTPEMKIQEVKRNLSWGRDFFKY

SEQ ID NO: 5899 - protein, 514 aa, Methanobrevibacter ruminantium
MNETIKEHSWIPLILVCFATFIIALDTTFMNVSISSVVADLNTDVSTIQTISSFYTLITASFMLLSTKLQDIVGKKKLFLIGAGIYGVGTLTAALSANTLMLFIGWALLEGIGGALMTPTAVSIISGTYQGEKLTFALAIESALVAIAAAIGPLFGGVVTTYFTWRLGFAVEFIIVLIVFALQGKIPYFEATGSKSELDITGAIISFVGLVLFVMGILMLTDDTTFSIAIMAAGLIVLALFALFEIKRKRKGNVPLLDVELLKDRNLRVGTLLRLLVNLAMGGALFAVSVYLQSVLALSAFNTGLTLLPMTLGLLLFALTAPKLSAKLNHKILMSIGCIISIIGCLILSQQFTMATSMLELMPGLFVLGAGLGFVMALGVDIALSNIPQEGQNNASGIVTTGQTLGQSMGTAIIGVILILGIIGGISNAVDTYVPDQSGNATFEHDVYEGFQSISSINDVKAENSTIQNIVNVIVRDSMAFVMYVTMALMAIIFVLTLRLSDKEIKKPDKLKKQ

SEQ ID NO: 5900 - protein, 244 aa, Methanobrevibacter ruminantium
MTTTNDQDESISEHIKKAFSLKEDTASNEEIRSRLLDGGKITGTNMRVLVCAMVIASVGLNMSSTAVIIGAMLISPLMGSILASAYASVTNDRPLLGKHLTGFAMQIIISVTAAAIFFFLSPVKEPTVELLARTSPSFYDVLIAFFGGLAGIIGQTRSDKVSTVIPGVAIATALMPPLCTCGYSIANGRWDMLLGAGYLFLINCYFIFLSSSLILSALKIPKLKEYTEKEWKIHKWRMSYGILF

SEQ ID NO: 5901 - protein, 657 aa, Methanobrevibacter ruminantium
MRDIEELKKTPGLSLKRYLILFIANLIGLYLISFGLDFTVTNLGRVIIFIFFISIFNAAIWPLVTRIYMPLMVWTFGIGALLLNGGVFAFFGPYFGLDISGWGIVLAPLTIALITIVLSTLMDAEDDGTYYQAVLREAQTKRKGEIKDYPGLIIVEIDGLAYDVLLEAVEKGVMPTVKSMIDNKTHILKKWETDLSSQTGASQAGILHGNNENITAFRWIEKENNNQMMQCSGVTKVKVLEERISDGNGLLVENGASRSNLFSGDTDNVIFTFSKITDLRKLYNGAWFSIFSNPSEFARIVILVIEDMVHEIYSQLKHSILNIRPRISRGIAYIPTRAGTNVFMREINTETLIGDMLIGDIDVAYSTYLGYDEIAHHSGVRDEDVWFALKGMDKQIRRLIYGNKYSPREYEFVIQSDHGQTNGATFKQRYGQSFEDFVKSLLPHETNIYAKMSSNEDHFAEVYIPFKDRIDKFKNRNKPDEDKLISESEVIVLASGNLAMIYLTRWSHRLTYEEINEMFPDMISEIVNNEYVGFVLVRSSENGDMAIGKNGIYYLDSDEIEGENPLIGFGDNVTQHLKRNSSFQYTPDILVNSFYDVENDEVCAFEELVGSHGGVGGSQSEPFILYPSDWDIPDEEIVGAENIYRILKDNLAKMKEK

SEQ ID NO: 5902 - protein, 94 aa, Methanobrevibacter ruminantium
MDVMDMIKEIETGNDYWQEGLDYHMDCKVTVNNVRTRCDQVSIVQCDMSKYGKGIELLLELRRGDFISWIYLDDVVSFDVQMMDNVLREEKKNH

SEQ ID NO: 5903 - protein, 85 aa, Methanobrevibacter ruminantium
MIDEMMKIEQFTSHCCFVDEEGMNSVDGDFLTAIALCVNFMYNFIDIQNIESGSEDEDDLNFQLIMNKIEYYQKMEEICKKYKEE

SEQ ID NO: 5904 - protein, 228 aa, Methanobrevibacter ruminantium
MNKINILSVSRLRTYTDGDGITSLVATMGCPLRCAYCLNPSSWDGTAYPKSLTVDELYEELKRDNIYFLSTGGGIAFGGGEPLLYHKFIRKFIEKYSSTKWKFYLESSLSYKTDSLKDIIDLIDYFYIDCKDMDKTRYELYTKGDYDLFFGNLIYLKEHVDNNKIKIRVPRIKGLHKSDEAESNLKVLQEMGFTNIEIFDYIDDVEIHKPISDKAIRNKKDFLERIKE

SEQ ID NO: 5905 - protein, 159 aa, Methanobrevibacter ruminantium
MNGRDKCELLNEVRQRIAKANNIEFDFEECTFEGNCSGTCPKCESEVAYLERELEKKQDNGEKIDIEGIFTLKEKEPTKLLCKDVFVPFGNFEPVRPKMEILEKSPYCETFGDIEYKDYAFTYLKIFYLGNDEEIVLPYNEKEYDGDITVFEIKEDEYE

SEQ ID NO: 5906 - protein, 183 aa, Methanobrevibacter ruminantium
MYQWCNLFGKIHRGQNYEDIKEDNCRMLLDLVRKYPEHSDIIYLKKVKDIGTSSKMDNSLDERINQMEEALKPVHDMVDDVYSCQINDDLINLDDFVPFEFLSEYAYKKRFWLTYNEKPDIFELETSYRDKIYSFDSVTESVIFVMDEMKNFIDKYPQYSRLIPDYSSFIKYKEKLIEEFEGE

SEQ ID NO: 5907 - protein, 58 aa, Methanobrevibacter ruminantium
MKSELVPGYDFEYTYDGVLLIEYDTYHYKNYEINRVYLEDHIEKLIKLPDVYVICLEQ

SEQ ID NO: 5908 - protein, 72 aa, Methanobrevibacter ruminantium
MNENNKKIKEKSAEDYSDLDSFLEEVFGPTDDIEWTEEKRKRFEEINNKCPFSPTRNEWPNIKIHREELKED

SEQ ID NO: 5909 - protein, 685 aa, Methanobrevibacter ruminantium
MTEEINEKINTQLEEEIKGFGTRVVEIFKNTKSTKKENEDPEDDNTKKSQEFITVAEFNEFKIETLEFVTEMNNKANNLIKASEKFGDPEDDYAEIVNKVDTLLQGLHNELLGKEITIEDRLDKRNTLVRMSLKVHQSKRILKLLDKQSQMRSAEENNLKKDLSKWFHKLERRIQNLIDIYYENELFFLHINKVTTIVEDMKPEYNTILLKHGLTVFYNARETATTLYTIQQKKVSSKTGLYEPKIMRETDVGLFRTNPEIEDSLRYSTFQASNSTLIRVSKNITNNLADSYHKGLGIEDVGHKITEEFTGLKGWQAKRIARTEINSASNVGTFSVYDELGVEYHMWWTGNDARVRDSHKPLHSHIVAVGNTFSNGLLHPGDKSGPINEWINCRCTSVPYIIPLGMMAPPGVKEFTEDQLIPIPDYDSSKDRGKIINSSSNSFNNVLKVPNNKLKKEGHNFRKKELEELLELKIREKSLKQPIIKSDNTPLVELEHPILKRELDNFDKFLEDKDIEYFQMYTFDGREASKLYIGKMHEVDVPNEEIIEAVRKGGKISVHNHPTNFDNMHSISDIYTQIETGIELNIVKSYTKKYIVVAEDLSSKERKYLLNQLEKIEKKYNEFIEKEKKPYLRGLDKIDLTVAEREYAEEIIHQYVVINNYDKYEKVMSYFFKANPSIDLYVYDI

SEQ ID NO: 5910 - protein, 165 aa, Methanobrevibacter ruminantium
MLPVFIPNLPDCEYQYGEKPLTADQIIQFARDYEEWLIVDLEHEFLYTGQVIGTVIKSHVNTEPVTVKFIDSTPREYPTGTWFVTLKITNQDVIQGIHNEHYTGGSATTIEREDTDKLRKILNVPITSTTKSKIKRIPISEIKNPVVITISIVHSPCVPLANFVV

SEQ ID NO: 5911 - protein, 340 aa, Methanobrevibacter ruminantium
MVEFDSFINVEKVIEAKDSNYVTKELSFDDKTILNTPYKIFNVSKVKLNKLELPLKGNIIETTKFINNKKSYDALYNLLENSPNNQKSKLNQFFKVDNTFKSYKSIISLTFSKNPFKSNKFTHGHSKPLSFSNFEYLLDYMYEYSTLFVLIPDIDFKSFDSMDNYMEYIEKAVNVVSSFNNKPIFVPLSMKLDNSNLEKLLHFYKENNYSNIWFNFYSNQINTKISIIRYSLRLINRLFKGNAVTYFSNMKKEINKHLDDVYTLPSDFLGPFFGCDFLGSNRESGFPGKNIKRTAKEKREFERKNLINKNRIFDSSSYYYFSILEYPSDLRIKFKVNSTN

SEQ ID NO: 5912 - protein, 189 aa, Methanobrevibacter ruminantium
MFFADFLRFLSYGFLEELKQSNCYNFLDYYNFAIGSKVFEEINQHLDNNLINKLHFCPNNNYNYSALIAPLLSNEEKNKNKGEYEVIGLSLHYLSLNQVKYIIIDDKRARKFAKRNFEELQEYITGTIGIIIFCSKDNFISKIDAANILKDIEFAIENHDETQGNFICSLGKQNYKKIIDDAIKMLDVE

SEQ ID NO: 5913 - protein, 190 aa, Methanobrevibacter ruminantium
MTLSNAEYKQKYIEYLILLLLGDFKNKLSVLHIQKEIYLLYNFDVELKKLFSFVKHYKGPYLDLINSCCETPFYLDGCWEYFEPKEKISGGFLKITDKGYKEYLKFLQKIKDENQEELLHINTAISMLNRLYGSLDCEELLLLIYTEFPEYTEKSEVYSNIISKKTNIAKNLFEKKVISEEKYNELSGIL

SEQ ID NO: 5914 - protein, 922 aa, Methanobrevibacter ruminantium
MEPTISSRLLIFIRNDLKNDINELLGEPKCGKGSAGIGNLAHMPWLDFTLHNIDENLGAINVAYLFKPDMSGFYLTFRALFYQEIEKKHGKYLLIYLKNKSRHIREFLEESNKLRDDFLFNMDFSEDTAVLKKHSAGTIVAKYYDASNVPSDEELINDLNYFLDLYAFVIDNYENKTDLSVDEWVKVLENKELIDDKMFSILEIMNEMDNYSATTSQISKKREELGFLDEKSYNSIIISNSRKIKEFLNKKPIYNDDGTENYWTRFFYGKNVDGAFEFKMKDELVEAFKKTNVEKRKKGGEEVTKNYNSFYDFLLDNGYLFDKGTIENYLLSLKVKPFAILTGNSGTGKTKLSQLFSQYISNNNPILVSEMNRLSKDTEDFVEVQVTTRRSSWNIFEKGKEMNPGWTISNEFFSNYLPIDQFSGEYQIEVDGIEGNGIISPVIQVYYDKNSLKLKKEFEKLYLSELESIEKDKENKVSHEIQLVGLELNVNSLENMVNTNFTKFKGDISFKKEITTTSIKPGEFIVPYEIFDYIPFNKNQMDCKIISCGRFSNANIHIKFKLRKLSKNIREYLEEKGVGAEIDVKIKNIDTSLERFNPDWSSAKRYSSEQIAQLNEKNIDLIDFNSQNYKIIPVGANWTENRNIVGYYNVITNKYQSTPAYDLITQAQKSDEPHFLILDEMNLSHVERYFADFLSAIESKEKIPLYGEEALEIPDNLFIIGTVNVDETTYMFSPKVLDRANVLEFKTYSAASYMNGDIKLSGPDGNLSYLENPLDGNNIRSKGIDELRELFDGVKVENKPFWNILSSEIEKFQSVLKVSGFDFGFRVINEIVRFMAVAWEYENKPDEFSNWERYFDAQIKQKMLPKLHGSEKIIGDTIDELHKICLDSSIDDVEMAKYPESYKKLTEMRKVLRKQRYVSFIN

SEQ ID NO: 5915 - protein, 547 aa, Methanobrevibacter ruminantium
MEQYIKINAIDNESNQLGTFKISKEYDGYIPSIENFNKEIILENLILYNVPIVEYFDNKTPIQYYKNDSFNANILLLEEYEYTIEFEGDLNLDVYESLKNSKNSPLKLLSNTNSGFLNFGSYVGKTFIDIYKDEGLLFKCPIEVRSRKINYAKDYATMIGDLSRFSSGLIYELNSPVYQSLEVSDINKTPYEDFMLLEYLFEDENLPSTVEYLSRNLYTLLEESREEVPSSLASNIGPNELVEVFSNSDNLERYDGLDNGHLDSVLSRTKGYLPLKINEIKYVDNIDTPENRFYKNFLLYIDDLIDDLIKRIDEGYSLDKLHEYKETLSYYLSSRYFLDISPMDYPPLNSQVLQKKEGYRDILEYYLLFEFGFKLNWNQVVDDFRGYEKKVYRLYEYWCYFELLDIVGELTDTEIRFDDLFIEENLNISLREGAIKRFDLNLSDLLDNDLPSSDDLDIRIDLMYNKTFNKDMAFHSYSVALRPDYTLSIEFGGNAYRIHFDAKYKLNINDESFKNDDIVKMHSYKDAIGDTIAAYVLYPGDRKEIFL

SEQ ID NO: 5916 - protein, 1178 aa, Methanobrevibacter ruminantium
MEKTMKSKLFILLIIISILISISSVSASELQADASNIDNDYQTNMEFDPICNDESNQNQDLNLKNNNEHILKEENTNPPEIEDETCFTTLYQEINQSDDELNLTHDYIFNKSYDNASLYQMYYGPLISVNKTNFTINGNGHIIDGNEMGAEFDFENNKGEIVINDLTFKNFNQTVLQIYGKLTLNNVNFTESFESLESIIFVSKGVLNVNNCSFYSNRAKNIISGSQSNITVNNSIFSGNGNYERAISANRWQLVIHNSRFENFTFKNGAIIDFKGYYLDLENSSFNNIHSNLSGGAILGKYFPAYIKVANKTQYLPSDPMIIKNCRFENISCLNDGGAIHFDFDSGSQRIAQSLNIIDSNFTNCSSKYGGAISILGGGLNLEKSNLLNNYASFEGGAIYSSWTNINITDSSIKNNKAEKNAGAIYFDKGNLSIKSSDIINNSALEESPTTANAIYAHDVAADFSDSTFDNGGIAVYADFASHSNFTNVNKNDDIFLMDNHNYIVSVETPGIKLNLTNNEIIVDSLPSKFNSQDWGWTTPGKVQGDNDDCWAFATIASIETGLGKSTGVLYNLSQNYVQKLQLKYYEVGDLRNSLTGFITSGLGYALSWYGVLPTDAAYDDRGMIADSDMNVPRIHVQDAMFIYTGENNTIDQLKKAIIKYGAVTVQYWAYREGEEILSEGEDISIMEHNTHFISLVGWDDNFTNDFGGAPGCWITKDSLFGYSNTEYINFADIDYFAIVPLRVAVAYIFENDIDYHVNYQTDLTCLAGFDQNYTIYSNEFTSKYDELIGAVGTYFNESGIKYSFDIFVNDKKVQTQNGTSEYAGFRTIVLNNYIPIKSGDQFKVVFKSNSVPYQAWSRVHYLNGTSLVSADGSTWTDFAPLNKTVCLKVYTLNDTTKLADANDMIIEYGEDSYFSVRAATENNISVGPGEEVTFTINNNTTTVKTNDEGVAKIKISEAPGTYKITSSYNNQSYENNITIISRERTSTRILYQNMSTVAVNSKVDGRIGKYFEVNLTDDEGQPLNNMPVQIGFNGAVYNRTTNATGGVKLQINLGYEGSYTFAIAFLGDNKYAGSFEVAIIKVSKQAPKITAPAKTYKASAKTKTITATFLSDKGHGVKGKKINFVINGKTYTGTTNDKGVASVKVSLNKKGTYTCTAKFAGDGMYKATSTNFKVKII

SEQ ID NO: 5917 - protein, 354 aa, Methanobrevibacter ruminantium
MKGLARIEQDVLGWVDAELDECGPYDAICKPLAMAPCTSDVHIVWGHAYMSDAPNRVVGHEATGEVIKVGDKVKDFKPGDRVIVPAITPDWLTVPAEQGFSQHCYGMGTGMSFVTFKHGVFAEQFHVNQADANLAHLPDNVSLEQAVMISDMMTTGFYAAELADIQFGDTVACFGIGPVGLMALAGAQVKGASHLIAVGSRPAAIKVAKEYGAHDIVDYHNGSTVEQIMELTDGKGVDKVVIGGGGKDTLSEALSVLKVGGVIGNVLHYDGIETIPVDGLSWGQGLADKTIRGGVCPGGRARMEKLANLIEYGRFDSSKLITHKFDKFEDIEEAMILMRDKPRDMIKPAVILDE

SEQ ID NO: 5918 - protein, 623 aa, Methanobrevibacter ruminantium
MISKLKKTIISFIIMGVVSFAVTLLPISGGMSMLAPDLGLIYVLGLLFGPYGALGVALAIVTLNLINGFTLMETLPFEIFTFGVSYLGYRLWYSGFKTDTITKPKLDNSYHISLFLVSIIICGFIYSTVQGISFNLIFWVDRFYIMILFYFMSFTTMAFLYGIIGIWICNRYDCFETPKKSKRHVDKRIYQAIFCMIIITSIILATSFITTDDTTVRIIELIVLGIFLFAYLTKPFEYDITPNDKDTISGRIMRNFIIITFILGVLGIAISMISYSAYSQSDNVYLVLMWGPIITDTVLLLFLIPCIFILRYIEDKVVQPISSFSKIEGFIKENEKIDEDGLVKTYSKYTDEKTEIGTLARSYTELIKHNNNYIENIREIEGEKERINAELDIATKIQESSLPENPIKTNDFTVEGYSIPAKEVGGDFFDYYMVDDENLAIVIGDASGKGIPAAILSMITQFMIKNFLKQTLNPSEVLYSLNNQLSENNPECMFITLWLGIYNTRTKKVRFANGGHNPPLVKEDKKFKYLDIDTGLVLGITGDFDYINEEIILKDELIVYTDGITDATDEDSNIYGEDRLLKFLNEFKGDEVPIKPLISDVNTFSKGVEQFDDMTLLCLKLNK

SEQ ID NO: 5919 - protein, 99 aa, Methanobrevibacter ruminantium
MNVIKNYNGKELTMAVDGRIDTISAKELEEEINAEMGNFDSLIMDLGDLEYTSSAGLRILIATQKKLKSEDIPFVIRNVNDAVKEIFKMSGFIKILNIE

SEQ ID NO: 5920 - protein, 2687 aa, Methanobrevibacter ruminantium
MDLFNLSSAQKMLLFSEINNPQNDSFYLKFRKDYDLGDYEYVKSAIELISRKYLNLQIKYDENADFKQYFVDADEVNVDSFDFSGSDLDGIDGDIGGSGVGSFDGDIGGSDVSSFDGDLDEFIKNYLDKPFDDIFDSPLYKWAVLKTSDSTVLIGVVQHILLDGTSLYSIVPSEIERCIDSLKSNEEFIPIDYSYETYVNDELEYLNSSQSQEDKQYWLDSLKGYSQDWYSFDDSELGFYEILLEKVPDFGYSPFVTALALSFLYFSKSKEGNESFKDMVFNTSVHGRYFSQGDALGMFVNTIPLRLSYDGDMTFDELLAYSKSVLKEGLGHAKLQFSEYTTDLRNEGIDPDCISMFSIVSNSTDMNSKFLTLQKDIKFPLHFRINKNYSDKKGLQSIFIEYDKACFHKREIASIAEGLKYLIRQLIDDSAKRCADYIVHEAEFFKGENYYNNLINSFDNPTAISPDLSGDKVRFVNISKHIDIDKLKNLSNRYHLSKEKLLLAIFLYDLSKFSFSKDILIAYNRVAAGYHFNTDLTVEEYLNDFKQSFEEYNNYPLLNNRKLNFESEILFFINDYDAKDYKLVFNFESGKINISYDESFYSKELMEAFLDSMDVLLGRFDSSDEPLKEISIRRELELDEGFEIELANEGTVKEMFENIASENPDKTILYCEDGQLTYDELNRKANRIANGLLKRGVKIEDKIMFMMRRNSDLIAAVLGIVKAGAAFIPIDPNYPKNRIQQILDDSDSKFVITSSEIDYDGDNRIDVDELLLDGDYSNEDNVDSNPDVDLTPDDSNPKLDADSNPKLDADSNPKLDADSNPKLDADSNPKVDLTPDNLCFLIYTSGSTGKPKGVMITHRGITNYIANVKENVPIYELNHKCSGFVSISTVSFIVFLREILGTVLNGLPVVFANDEQAVDPLEFAELFNNSDADAFGSTPTRLLEYLQLEEIQDLVGKCKVIIVGGEGFPPVLYDRLRKHTDADIYNSYGPTEVTIASHYKLIDSNEVTAGWEMLNVVDKIMDIDGNQLPPYVTGEIYVGGAGIARGYLNNPEQTEKVFLTLNDIPYYNTGDLGKKDANGELYVAGRNDTQIKLRGLRIELSEIEGAIANYENVSLSKVLVKKLNNVEHLCAYFTASSEIGLGDLKQHLIDSLPEYMVPSYFTQLESFPKTPNGKTDFKNLPDPEIDADEFISPRTDLEKELFDIVSDILGMDEFGVNTDLFSIGLTSLSVIKLTSAIYNKLNAQMNVTEILKYKTIERIASEIKIEDDESRDIMELYPLTSNQLGVYFDCIKDLENTAYNLPKKIEFTEGIDVDRLKSSIIKAIDNHPYLKTRIVMNNGEVYQQRRDELKVDDLIEISDDENLDDFVKPFKLDEGPLFRFKIVGDSILLADFHHIILDGTSLNILFDEIAKIYDGKDYELEELDGFEYSLDEVKVEQSSLYKEAELFFADKIKEFDNASLIPQDINGDESKGKAAICDVFLEKDSIDDFCSKKNISQNNLFLAATSFVINKFVFNRDTLIATITNGRFNPNQQKTLAMMVKTLPLALKLNSDSTLKDYIEYVNLEWLNVLSYSSYPLTEISNEFDITPEIFYAYHGKIIEEIEIGGMTVERQSIDYEGLKFKVNINVVEEDGQYRIFCQYNDQLYSETLIDTFLDCIRIVLDKFQRFDENTLMKDISIIENDDWSVDDLEYDEIPEDRLNKIFESQVELHPDRVILYATDGEFTYRQLNEKANRIAHSLIKKGVGPEDRVMFILNRNSNVVASIFGILKAGGAFIPVDSEYPSERIEHVLTDSQSKFIIVDDVIRKKGIDLSDYSENLLDVNELLSEEDTSNPDPDVHGNNMAYLIYTSGSTGLPKGVILEHGNIANFVYPDPRNVCTYELVHNLEKEDYKVLSTTTVAFDVFQQEIMGSLLNGVPMVFANDTEYKDPIEMMDLIHRTGANVYIATPSRLLQYLEIEAMQETMYGFKVYIHAGEPFSARLYDLLSQNSKGKFFNMYGPTETTVYCNGQLLESSDIHIGKELFNVHEMVMDFDSNPLPPNVIGELYIGGKGVSREYLNRPEKNAESYEVINGIRFYHSGDFVRVTEEGNYYVFGRMDNQIKLRGLRIEIGEIEVGLSKFPGIKSVAVVVRKIKGNDHLCAYFTVHDEYKDEKRGENGYSIDIDDLKASLAEKLVYYMVPTVYMELEEMPQTANGKTDLRNLPEPVLITEYVAPENDIEAFFANLFGEILGLDEVSATDNFFEIGGTSLLVTKITMEALNRNYNLSYGDVFSNPTPRALSELILSDETAEKKSELSYDYSEINALLKKNNLENIINGEIQESLGNTLLTGATGFLGIHVLRELIENDIGDIYCFIRANKVLSGEERLKSLLFYYFSDEYSDIFSERLHVIEGDITSFDDFEKLVHERIDTVINCAANVKHFSSGTDIEDINLGGVINGLKFAKMKNAKYVQVSTYSIAGESINNYPPVDVKFSENDLFIGQAVDNQYLNSKFLAERAVLEAAVNDDLDVKIMRVGNLMARSSDSEFQINFESNGFINRLKAFVTIGKMPYSMLMNNVEFSPIDMTAKSIVALSKTPKECTVFHPYDHHSVCFGDIIEIIKPLGLDIEPAEEEDYEKALDEALADKDKQDGVSGLITSIGSGKVKKIWVPVENVYTIQALYRLGIKWPFVSEEYIYNFVKYLNDLDFFSV

SEQ ID NO: 5921 - protein, 486 aa, Methanobrevibacter ruminantium
MYERNYKLLRAKFSEFFLPTLFTSMAGNICLFVDGLIVSFLIGASNLAPIQIVAPVITFVNLIYWMIGLGGSVLCSVAKAEFDDEKSNSYFSVSIISLISIGVLITVIGLLFSGSIAQFLCSSQPELVSQVSQYFIALVIGMPFLCYMMSLSYFIRADGIPQLPFRAILIANIVNICFDIIYIKFFNLGLTGAALATSTGYLVGSILISYYFFKKERTLEFIKLKANAFFKFIKKIVTSGFSSASTQLYLTLKLLVINFLVGLYVGKSGVVAFGICYNSLFILYIFLIGTAQTMSPIVSVYFKEEDYSGVDYIIKRSLKIVVASSLALSVLFIFYPQALLFLYSVKDPADVPVVLNALRIFAISYVGTAITFLYTFYAQAIQKNRLSTIISLLEGFLLPISAAVILSFAIGGNGIWISFAIAELLTILFIFAYSRNINKKTNGEYTGFFINKHNDDERVFEYTINGNIEEAVNLLQRKSQKLPYLG

SEQ ID NO: 5922 - protein, 78 aa, Methanobrevibacter ruminantium
MLVNIININDVVDTIDIIVRKNVDNILISVKDTGVDFNPVVENEELKFDNISVLNKIADKIDYSRVLGLNSTVITIKN

SEQ ID NO: 5923 - protein, 487 aa, Methanobrevibacter ruminantium
MTVKVFISSNQNEFFEERKLIKKELESDSMFKNYVDVFVFEENEARSLSPQENFIEGLYNSDVYIGLIGSSYGDIKDNGLSSTEYEYEIFSRLKNKQNIYFFIKDSNEREDKALDFIERIKSDTSFKIFHNTVELIEEIKRSLKAHINQSLSNQEFDFQLLAESSCDDVSKEALDLLFDSIDYQPILDLLGNRDMESILEILSLGKKDLSGTFRLNNAGALFLAENIEKFNIEHEVKLVRFKGNTKLEMIDKCYTTSPFFILLKEFEHFYWKNIKVGSVINGLRRVNIPEYPFNAIREAMINALAHRDYSFKGSFIQFYIYDDRIEIISPGNLLYPLKVSNLKNIEVPVHRNKNICNLFSKTIFMEHVGSGIQRMCDEMRKSGLREPEFINGEGFFKVIFWGPNGKLIYPEEAVDNNVLDLTKVGLNDRQIRALSRIVNEKVKYSYERYSNEFDVSKSTSKRDLNDLAKKGLVIENKSNRRNYYFVE

SEQ ID NO: 5924 - protein, 175 aa, Methanobrevibacter ruminantium
MIDESILNLFKDEKIRSIWDDKTGDYYYSIVDLISIITESKNPDKYWSDLKRKMKKDEYNLLNKYIVQMEMPSSNGKMRLTDAGDIETVLRIIQAVPSPNAEPYKEWLAQVANECLEEYINPELAIEMAIGAYRKKGYSEEWISRKLFSMEIRNGLKKEGFKEKTNREHVLDSLA

SEQ ID NO: 5925 - protein, 409 aa, Methanobrevibacter ruminantium
MVKRELYMNKINSFIDKDLIKIITGVRRSGKSYFFKLIINELKERGVAEENILLIDFELPQYRHIKTSEELDEIVLDFIDSHPEKTYLFFDEIQNVSEWELSVNSYYKLSKSDIYITGSNFKLLSKELASFLTGRYVSINMYPFSFNEFIDYKKEIGSLPINSNELNTELENYFDEYFRYGGFPTAISSNDHKEIILNDLYSSIILNDIVTRYEIRNVGLFSRIIKFLIENVGNLISANSLYNYLRGQGMEITKPTIYNYLNYLESANILSKITREDLVGKREINGSEKYYLIDQGFYRSQLEIKQENTGRIIENIVYLELLRRGYTITIGCIGKLEVDFVCKRNNERIYIQVAYYLSSDETIEREFEPLRRISDNYPKYVLSMDKTDQSREGIKHLNIIQFLRSSEDI

SEQ ID NO: 5926 - protein, 3053 aa, Methanobrevibacter ruminantium
MVIMNNKKLFIVSLIILTILTIGAVSAADDGLATSDEITVDDSSVAVSTASAESDIYETNGDIVADYQSDSISNVTVDDDNTKDEIIRSSPAKDNLLLDDDDDPGAVNDDDEGDDDEDYLDDISVSITNEYDVTDQDAVIVSIFVPDVEEGEDGIEGYFVVCLDDDDEIFLGPFNHTITPDDYGTDVTFTASDLEITEAANYWVRVFYVSDLAEPLIDNDEEDGYNMIFDGDCIARDYTQFYVIVPPDGRISIFDTSAIYTVYCPPGSEGTVTLTLRDEEDVETSFTQEIEDADDENQLYWDLDYMGLNTIDAAGNYEVTITLENGTLICEDDIRIMDPIEIPEVSYINSTDYDHATLVALIKIPSELDDDLEELIDGTVIIQIDDETVFEKTLSEFVEGESPDDPFWVYPKIHWSDELDTSVKLYYVLNNQLDIDLEPGTYDVTVKLDLDGWDEVSSTEEVRLVESNVVIDEDIGASIEIFDQEDILNDNEVRIIAITVTGDKSGRVNLAVEGCPEWECPLDELENEGDIYYINSGFDIESGEHEVVVSYVLNDDRSVSNSAILNFIVYPRIFICGNGGEDIVNYFADEDSAIHIYPKGDDVSTIRIVVTIGDEVVLDSTIDDLGLSPKINDWGETYYTVGPANFNKKLEFGHYEPVVAYYYSDAYELSTEDGELSFIDIIGMVHVADIEDDETPVLAVCSDRDGQIGVYIRQYTEDGDQELEPKYFEVEKHGFIMPTIDQLGLDEGQYHIDVAYADDEWIFGNDLIVVNSSEYFVLYGCDWLYTEESVVYVWCPDDAEGIISLTNNDGTINVDHEITDEDKGKYVEFTLEELGISGPGWYEISVRVNGNEIDHIGFDVPSPIYMPNYNVYLPEEGYEPDYSMIIAKLELNSELEGNITINLDGTIVFNKDIEDMEAIKDGSKWIYTIYTSDLDEAEEGMHDVTVTFNDLNEERSIEFLNRTTESDGNLSIIMLGGTYCINWNDVIAEVIAPTNYNGRLVLRLQGEIMQSWDELHWVNWDNYNDTHNIYYIYVDNLDKMCIENPGEYTVSLEYYSDREDENPSLQNSEEYRFVRDEEPSGDFEWEVYHWADYEDENSLLVTVRYNDNIVDGRIEINIEDPNGITLTDSRDVGEGYEDTWLVSDLGIQEYGVYTISAKHILGDDEEIIFENEPVYVTKIQIRGEEEVYVDDPLFVLAIYHAGDRTTVYLNGAGIEGRRLPNGGPLVWYLSDLYINEPGEYDCTIQLFDEDDNLFAQTEYYLNVIEGDDGYRLIKNLDWDYFTSSTPVAALYCPEGSVGDISIDIYAPDDNDDDYRSRDIVNTILDSIGSEDVGGFKIWTLGDLGINEGGWNYGFVLNDADGDTITDENGENCEFGFGAVLYHGIGIAIWDQNPVALDNEWLVDIYSPLDNDGDVILMIGDEVYFSDTLQNLAMYQYDEDIEQGCAHFHFGANSFNRTIETGHYEEVIVYYDGFDGYSTDSTAFDCPTVLDFGKPMNFDWSVKGAYYEYYDNNVINVWYNEEINGGQIKIIARAENGTEYESVKDYNDNRNNEWTITDFGISEIGKYNLTLIYINEGDEEIVRDDKVLQVLTFDPRFANWVTVDHPYDVLAIYQATEEIRVYVNGEGPYEGIKMPNDGPLSWDLEALGISAAGEYEILVESYDGEGNLLSSFEDVLYVSDEMNPNEYRVEYANDWDFYSLDSPVFGLYCPEGSEGPITIEVYGPDDNDALLNTINDNIESGDIGTIKSWTVGELITNLNGWDYRFVISDANGIIKNGNDEDIGEFNRGINFHDSIDYISINEWSYLDDEWFIDIFAYTGNDGDVAVEFDGATVYNGRLSDLLFFQSDEDMQRGIAHYHIPVSYLSNEGNPIEAGLYLNIIVKYYGDDGYNTTGYTLQSYIDENGFDWANVRLSVGDDPNTIILTLTNSHWEPLADKEVYISVNGGERQWGLTDEYGIAIFTIDGGNCTVRGEYENAENQWSAYEMTLCVFGEPIYPNATIRLEFVDGEVIVTLTDGDGAPLANKGLGLAIDGIVVIGPSTDDYGIYRMGIEGNATVEISYQDENGIVVSSSITIVNNTETETVYVGPNATIRLEIVDDNVIASLSDGDGAPIANEFIDVSVNGVPVNGAMTNASGLYSISVEGNATVEVSYTDDNGITVSSSIRIINNIETVPEPVNVLPNATIGLSKDGDSVVISLKDGSGAAIAGASVNVSVNGGDVTLVGPTDADGKASVEISGNATVVASYVDNNGITVSSSIVINSETVPEPVNVLPNATISLSKEGNSVVISLKDGSGAAIVGASVNVSLNGGDVTLVGPTDADGKTSVEISGNATVVASYVDNNGITVSSSIIITNNTEIVVIEKSHTADALFNVIIQEDKLGVWLYNNNEEELANKNITVVFDDDEEGQNYLTDGQGYTSIPIGDHSIIKLSYTDEDGASVFYTVHLFETGEVVDADYVVIYITPLDDSSLEVSVSVNGEDLEEGEITYYLGEDAEGITVDLEDGVYVINYDNTVNQTIAVEYIDDDDVSWYAYYEVVVYNNTVTETVYLSPNATISLSKSGNDVLVSLTDNDGKAIANADLDVLVNGAKSTAKTNAKGEATIAINGNATVVVSYKDANNITVTSSITVVNETETVVIEKNNTIIEYVNQTVPPNATVSLSLVDGKVVAEVTDGDGVPLANKLLAVTVNGAPKLGAETDANGIYSIPVEGNATVVVSCTDNNGVTVSSSITVLNNSETVVVEKNNTIVEYVNQTVYVPVVSNSSFDIVGDENGISAILLDEDGKPISGAVVELDVNGAKSNITSDKNGEIVIPTDKNGTITMTYTDENGAKLIYTTKVITQTEIIYQNQTIEVPVYINVTPNRASTKVIYNNMSTTSVNSNVDGRIGEYFKVQLVDSNGKALANKTVYIGFNGRVYVRQTNETGGAQLQINLGYQGDYTFAIAFLGDDDYNGSFEVAIIKVSKQSAKLTTAAKTYKTSAKTKALSSTFKSAKGNAISGKKISFTVNGKTYTGTTDSKGVATVKVSLSKKGTYSFTAKFAGDGMYKETSVSSKLTLK

SEQ ID NO: 5927 - protein, 282 aa, Methanobrevibacter ruminantium
MRNIFNEGELDKDSVCAKIAHTASDGKIYKTNFYNLDAMISVGYRVNSIKATRFRQWSTSVLKEYMVKGYVLDDVLLKNGTRFGKDYFDELLEKIREIRASERRAYQKVTDIFSQCSYDYNPKSEVAREFYAKIQNKLNFAITGHTAAEIISERADSEKEHMGLKTWKNSPDGKILKSDISIAKNYLSEDEIKSLNRLVNMYLDYAENQAYMHKLMGMDDWALKLDSFLEFNDFEVLDNKGHISMNEAQKIADAEFDKFRVKQDKFYQSDFDKLLEDVKRLK

SEQ ID NO: 5928 - protein, 486 aa, Methanobrevibacter ruminantium
MEYKKMLAEIDFSKDLIGFFEDKNLCIINESLLDGTFGLSRDILFDKRILFNNDSLIDSFLLNAKAYNLNNEFFILLSNIIRNDFQEAISNKSNNEILDFEETLEKESPFYSGIPVSKEMFVGRKDSIHKILRNFPHIFKGQTRHFFLTGDRRMGKTSLIDFIGEYMKSYGVVSVYISNKGNDSVEFLAYEIVEGLIDELTLPDESLKTKIVDFFQDHVESVEFKGTKIKLTVDKNLSVSFKEDFINHLKSIYDEFGMDKKGILIVVDDINGLSNSEEFVHWYKRMADTIQVSHINLPVYFLLAGYPEKFYNLTRLDESFGSIFAYDNLDRLSNMEVLEFFESSFGEKSMLIDKDALFYMILFSQGQPLMMQELGESVFWECPNGHIDKYIAIRGIINAANVLASRQIKYTLNILSEDDKAIFKSLISDGKFFFNSSDICDEGFLESMFDLSLIEVSKKEDYDFCFKNTLVFIYFWVEAIQGLIEK

SEQ ID NO: 5929 - protein, 4825 aa, Methanobrevibacter ruminantium
MQAIIPVKDNFLILVTNMKKSDFKRIFICLVLLTCLIGAVSAAEDVSVDDVSTDAVAVDTITEDASDPTDISTVSEPVSNDVQANTSQELNKEPATKSTNVLKDGTSTNIYVATTGSDENDGLTQSTAVASLAKAVEIVNATAGTDFTINVANGDYNISKIESPAAKNVNLIGESKEGAILHASDTYGINVYEDNIAWTIENLTICDFNSTTSTSAAVRCFAIDSVFNINNCIFKNIGSKNGAIYITSTGTRTISNVLIEDCFGTYSSSSSIIHLYGEGPVTLDNIEIRGSYMDPSVGTATYLRSVIYADQAQTNVTLKNSRIVDNIGAMGSLIEAKGAFKVINTTFEGNYLNTSSNGVNGGTFMFYSGTSSNSASNIDISQSVIKDNVLAGGSIGLFNCVYGTHNIDHNVIMNNKYANGNDVPLGSFSGAAISTDDNYWGTNERPNTKTTEWVILTVDTPEMAFVGVSEAIPVNLNTYKTTNNETGAVEGMPDVDFGVTYALNQANPSTVTVANGQGTINYLATVDGNETLTFSTGDAFSFDVKADIASLIYVDGLNGNATGPGDSEHPYKTIAQAINVAADGKIIVIKSGTYTENSLIIANNITLKADKNAEVIIDANNEGRIFTVQKDAIIRDLTLINGKSTGNGGAISLDSGLLTLNNVKIYNSTAQSGGAIVSLSGSQLSVSNSEFIDNNASNGGAIYVAGVADITNNKFISNDPEDGGAIYVAGVADIESNEFTSNHATNGGAIYIDSENNQTIKDNTFTSNTADKGEAIYIKNANVSLSGNTMGENDSIYLDGASLKTTLTFLGGKTIAAEFGQTLNLTATLTDEDGNNIRGGIVTFTANGETIATIDLSTDAQLKTQYTVPNDAAGDITISGSYSLDNGGAVISGKIHPAVPHWFIEGGSGYETLADAIDGASAGDIIYYDLPEDYTEVISSKTINKALTIKNNGTGVVTLDGNLDRILSISSASVNLENLIFINGATATNGGLIYLSGSASNDLNISGCTFKDSKFTTTSTYTYAVAIYANGGNINIKDSEFRNLTAPKTGMIYQSSSSGAITIENSLFDNITGAYDGGLINSNGDVSLVKTNVTNIFGSTSTSDYGLIYIRSYGGFLFISECQFINISNAGAHPVYYRGSGGYNITQSLFMNINSNKIIDASAKGYVNYNIFANNSNNYVLYGSSSSKISADYNFFGSNSKPTSYVSNVNYTYWTIVELSSASDTAYVGNPTDIAIQFVGTDGSENLTLEGIMPEYTFTLNVTNGTIVPNTVTLEDNEANAEFTPTSVGKVNITATPGPAQLTLNVIDPSILLVVSTDGSDTNPGTLNSPYKTIAHALTQANATRNVIYLLSSDDAYAEHGLTVSDNITIRAEDNTVTIDGGQEGPIFTVTGTLSIEDIILSNAKVDEDNGIGGAIYLNGGNLTVNGVVFSDCIAAYGGAIATTAGSNLTVINSVFSDNKAKYGGAIYVAGEANISNSEFSDNNNEITYGGAIYVNGTGPVVISANEFDNNKANKGEAIYIENGAVNVSENTIPANETIYLAGGSINSVLIFLANGTISAEFEEEVNLTATLTDDQGNAIKGGIVTFTANGETIATVDLSTDAQLETQYTVPNDATGDILISGSYSLDNGGVVATGIVHPAVPHWFIEGGSGYETLAEAVDAASAGDVIYGDAGTYDVSDLIINKAVTIKANESGSIVLNGNGNQIFNTRANVILDNLTFINGSASSNGGFIYVYSDSLVINNSVFKDLKATGGLGSAIYVATGSSNITIENSAFDNIKAATGLINCRSKTTTFTLVKTNFTNIDVSTNGLFYLYEGGLRAYESQFINVSGGDGAVVYFYGQSDNIVTKCLFDNVTTTKTTGIIYSNSKSANITYNAFLNVNYGVYSSSSYGEVITADYNYWGSNDKPGTSLVNSNSKLNNWVVMTVSPDTLDSLDSGATQAFTVDFTHYTDGTANYTMADTIPELTVSASAVKGSLDQSEVETQNNVATFTYTGSQNGEETVTFTNANLSIPVKFVVGEGYFGIVYVAKNGSDENKGSEDAPVATIARAVEIAQRGSGQIIITEGVYNENNITINSEIPISIKGQGDVVIDGEGLSSLSIFTIKSGEVSIEKISFRNNKAKFGAGVNVQGTSGSSLLDANVLINECNFDNLSSDASGSQGGAIYAKYLKGNLVINNSNFTNSIVKSGGGALTVAYCAYEDALDLVISNCNFENNTANNGGAAYLMANTINIVNTSFINNNATYSPGALELYNCTGTMDNCSFINNSAKNTAAAFKLEFVKDQPITSLIVTNSIFKDNVGRDEVAPAIFVDRASLNISNSILLNPLNINTSTVTGYGAVPGQGVTVANSNWWGTNENPSNLTAGSGDNVNTTIDNWVIMNVSPTEAIGYTGEALEITVDFKYTMSADGTIETLAGTLPEEFTVNANAANGTLDKTTADTSNLQAKFAFTPEFAGENIVNIYTTESNTVPVTIMVTEKYAGPIYVTKDGDDENEGSENLPVATIAKAIELAQGKSGLIFIGEGTYVESNLTISKDLNITALGEVIWDANGQRAFSMSTGSVSISNITFINGNYTRNGHLIYCAGDSLKFDECKFLSNGGNVTGTNGVIYVELASANFNNCYFENNTAGTGTSYGLISAKDSVIIVDGCTFVNNFNKNGCIYVSGSNIGSMAVINNTKFIGNNATSASGGSGGAIYASGSMAYQYSNGTVRPGAQSAVYVIDCDFINNTAFGGKYYNAEGGAIFVNANATLYASNSRFIDNTALDYEETNKSGRGGAIAATTGNVQISNCIFQGNTANNGSVIAMKFANKDLTTVNVLSISNSVIMGPGEKLIVSDFTNGSLVANNNWWAANENPSDRVSEGITVDSWVILTADPSEITGTLDEIIPIVANFRHTNSTDGTIGDLEGEFPELEVFGMTLDEGEITESNLTVDNVATLYYTPEETGETTVYAISGNAMVPIKVTITDTPQPVADVIYVSPSGADTNAGTYEAPVATIAHAVELAGAEGASGLVVIEEGIYNENGIVINSAIPITITGNGTVIIRGNNHVVNGNGAGRFGDVSESTSIIIVNTTEAVVIANIAFEDNIAANGGAILIAGTSSSNLFDADVLVENCSFNNLQGRNGGAIYAYYAIGNLTVANCEFTNINATWAALCAYQAAYGEGLTVEIKDSSFTNNSANNAPALYLQATNVVIKDSNFTDNNATYHPGAIYLQNTTATIDNCIVANNSAKYDKAAIAIHGGNIQYNPVIVKPSEVTITNSIIENNIGRDKAAPAIYLENSILNMSYSSVVNEININNTVTATYGDEKPGLVLINNNWWGTNDPSTTIFGTNITMDNWVIMNVEANATEILAGEEVKLTVDFNHVNTTAGEIEELTGGVIPRESYSVALSVDNGTVAPETLTIANGATGEAIFTAANANALITVTSENAVETILINVGEQPVPFTGVVYVSKDGDDANEGSEDEPVASLARAIEIATAEEGSGQIIIKEGTYIVDGYNITKDLTITGEGDVILDAQNQGNRLFNMAYGTTVSNFELHNLVLANVTAMYGAVVYSYAANAVLDNITVAGINHEMARLISNYGNLTIKDSVFANNTVSGIITHSGNNNLNIVNTIFEGNNVTYDSSIMGVVYVSSGRGNITIEDSKFYDNLVRQSTVRGYTDTNITVKGTEFINNTADNSPYYCSGGAIFAQANLDVTESIFINNNARREGGAIYIGINGVANITKSEFINNTIYDNEYYGDAIYTKGTTAINYCIFLTNGTRYAVYNGGSKEVNAQYNWWGTNDDPQGFAYSADASNWIIMTVTAPSTQDIQAGDEYELTVDFNHYTDGSDILELPDSLAQELTVEFTSTTGTFDNPVVTTENQVATAKYTVVAGENSITVKSTDAVWNTSFTAGEKAKAKMNVSMENNTIIVTLTDEEGAPIAGKTISVLINEDTLSNETNSSGIAAISLGTLDAGTYPATISLADSEYQAPELTVFVLVEETLVDNPIGAVIELALAENGTSIEVTLKDINGQPIGDTIVRYYIGSTDGALLPIDANGKGSFDIDNTVNQTIKVSYTKEGTEWSSYYDFIVNNEVTPVPVANNAKFDVIVREDSIDVFLYNDNLDDFEGAKIMVTIGEEDPVEYIAGENGNITIPINGDTTVELSYTDENGATVYHTVKVSTSGVDPSAEIEIIVESHNDTSIEVSVTVDGDDVSDGEITYYIGDDDDGTVVPIEDGIAIIPFDNTVNQTIEITYSDGDATESVYYTIVAFTHEVPVEPPVANGSFDVETTDDAIVATLVDSDGKPIADATVSAIVNGEEQNFTTDADGKLSVPIDGNATVELSYTDPENGAVLKYVTDVVTKEVPIEVPVVANGTMSVETTDDAVEATLVDSDGNPIENATVTAVIDGEEQNFTTDADGKVSIPVGENATVELSYTDPENGAVVKYSTKVVTKEVEVPVDVPVVANGTLTVETTDDAIVATLVDSDGKPIANATIIAVVDGEEMEIPTDEDGKCSVLITGNNTVEFSYTDPANNATVSYSTKVVTEVEEVIVPVPVVANATISLSTEDGSSIVATLKDLDGNAIANATLDANVNGEETKLTTDANGIATIPVSANTTAVVSYTDSNKATVTSSMSLTVIETIVEINKTIEVPPVRNASQIVCEDMNTIAVAKDDGRIGEYFYVKLVDANGNALVNKSVQIGFNGRVYNRTTNETGDVKLQINLAYKGTYTFAIAYLGDDNYNGSFVVSKITVKQQSPKITTTSKTYKASAKTKALTATFKTANGNLIADKTIKFTVNGKTYSGKTNAKGVATVKVSLNTKGTYSFTAKYAGDDTFKATSASGKLTIK

SEQ ID NO: 5930 - protein, 3391 aa, Methanobrevibacter ruminantium
MKIKNIKYLLISLVLLMFLIGAASAADDAVTLEGDAAAVDSISEDASAPITTTVSEDASIGTTFSDSAIESDSIQSNDDLELKNVTDVKQKDSSDALKDGESTTIFVSTGGNDNNDGLSLETAVATVEKAINITKTGGTDFTLLISNGDYNIEQITIPVGKYISIIGESKEGTILHASGDYGFDISYGCNFENLTISDLNSTSSTSAAIRIIMDNYDININNCIFKNIGSAYGAVHVYSNGKTSISNVLIEDCFATKSDDSSIIHVSGKGPVSLDNVEIRGSYMLPPAFPWSTPYLGAIIFLSSADPDVTLMNSRIHDNNGSIYSIITSKGKIKIINTTISDNCLNASYASIFSSGVNSNTATDITVTQSVIADNILANNAVGLLDARFGVFKVDHNIIINNKNANGNDLSVGDLSGASSFSIDDNYWGTNVRPNDKTSEWVILTGDVAECAFVGVCENIKIFLNSYVTESGEIGVIDGMPTVELAVGYALNQENPSAVTIKDGVGTISYLASIAGEETLILSTGDVFEFNVSSEIGSLIFVDGSVETSGDGTQENPVKTIAEALNIAADGKIILIKNGTYKESNLLVDKDITIKPYDGADVIIDGDNQDRIFTVTSTATISDLSLTGGNATGDGGAIYLNGGNLTLSFLNISNCIASDNGGAIATAAGSDLYLSNSIFTDNFASKGQSIFIGGEAEILMNDFVAHMDVLSPDASFNAISINTDSPVSIVSNNFNDNGAIKGQAVYIKDAPVSLSGNIMDDEIIYLESGSVNSNLIFMDGKTLTVEPGADVNLTATLTDDKGNLIRGGELTFTANGVAVGDPIDISGDNELRIPYTLPSDSEGDIIISGSYSFDNGGTIVNGTIEPDIPYWFIEGGRGYKTLNETVENAVAGDVIYGSPGTYIANGIFITKDLTIKANETGDIILDGNGSRVFTIKNQATLSLVNLDLSNGGSEGGGFVYIYAEGGNLNVINSTLRDLNIVGYPESFEGGAIKTYASSTINIESSHFENINSSAFAPILSGLGGVKLSLTIKDSSFTDIKGTAMYGLMNAPGKVNIERSNFTGIIGNTTKQTGLIFADSTSNYLINECLFSNISTDSVIRFKNNGNITVTKSVFQNIQDTGGALYIYNPGSAKVNYNLFIDNTNLNADSNRDIYSYGSNVDLSYNFWGNNSKPTESQIYDVSKAPYWTIEELSMNSDYIFTDETADIAVQFVGTDGEENLTLDDVMPEYSFNLEATNGTLDANTVTLVDNEAIVTFTPPSLTGTVTVTATPGPAELTFDVIETSKLLVVSTAGSDENAGSFESPYRTIAYALTKANETRNIIYLIYTGEDYKEHDLTLAGNLTIMGENDEVTINATIGRIFLVTGNVSIKSLTLSNGFDQDYGGAIYVDGGNLTLDYVNFNSNRAYGLGGAIATSSESNLYISNSIFTDNFASFFGGAIGTASGSNLSIDNCIFSDNKASYGGAIYLAGESLILTSTFDGNHILLDDGRGGAIYVNTTDSVVISSNEFENNFAYTGEVIYIENGIVTLSENTIDGDTIYLAGGSVNSNLVFMDNSTLKVELGETVNLTASLSDDCGNPIRGGSIIFTVNGEAIGDPIDISGDNELKTTYTVPIDASEDMIISGSYSLDNGGIVKAGSLHPSVPHWFIEGGIGYEYLSEAIDGAEAGDVIYYDLPEDYTDVISSKTINKALTIKNNGTNIVTLDGDGNNVFTVSADLDLINLNFVNGGNTKGGFISQSSNNLNIINSSFKNSASSSSAAAILSSNGNLNIESCLFENISSSASSNGGIICYSGSSGNLNINNSAFNNLSGKYDGFIIYSSTFTNIANSNFTNLLGPTSSGYWGGIYNSKSLNLTNCQFINVTGPKGAAIYSTGSLNVTRSVFENIITTNSVIYSYSSDSFINYNIFADNNKAIDSTRANADYNFWGSNDRPSSDIVSSSIYHDWVIVELSSSNDTIFLGSTEDISIGFLATDGEENSTLEDAMPSYGFELTVTDGTIEPSLVILEDNEAKAVYTPSAVGTVTITASPGSAELELNVMDKSTMLIVSAEGSDEGDGSFESPYATIAHALSQVTETRNIIYILSSDKAYKESGLVLSGNVIIMGEDNSVTINGGNESRIFLVTGNASISDLILSEGMADDYGGAIYVDGGSLALNNVIISQSKASLGGAIYINTSSDVSISSNVFEDNEAEKGEAIYIENGALTLTENAMGNETVYLAGGSVNSNLVFLANSTLNAEFGKNMTITATLTDDCGNVIRGGAVVLTVDGETIGTVDLSGSDPLEIDFYVPQDASEDMLVSGSYSFDNGGTVSTGAIHPCIFYWIIEEGRYGFETLDEAIDASRDNDVIYYDLPDDYEEILNDKVISHNLVIKNNGTGIVTLDADRRRMFDLSGDLELNNLVFINGATNKDGGFIYQNSGSLNIISSIFKDSLSSYSGVVVFSNGGDISIDGSRFENLTSRKGPIDFESNSGRVDIRNSVFDHITGNYDGFVIYCKSDLNIEDCNFTNLNSTRATSTNYYGAICHESGSGDLNISGSYFSNIYGPTGTAVYYKGSGTYNISKNIFENISSGANTCIIYGGSSGNINYNVFLDINCGITTSGGNIDYNYWGTNDYAGLGINGTVPNNWIIMNVVANDSDVIAENEVPITVDFNHYIENGEIKELEDSLAKEFTVQFTSSTSELDVDEVNTTDQVAIAFCTAVVGENNITVKSDNAVVEITFNASEPLESHMSVDMDDDNNLIVTITDGEGNGIEGKTVCLFIGDEVLNATTDSEGNAVIALDEVDDGAYTAKISFKDPEYKDINENTFVVIRTNELIEPVAANISIELSIEDGKVIANVTDLDGVPLAEKLLTVSIDGVPVLGAKTDENGIYSIDVSPNATVTVSCSDVNGAVASASITYVENNNTEEVVVIEPVSANITIVLLVAEGNVVAYVTDLDDVPLVEKLLSVSINDIPILGAKTDEKGIWSLPIEANSTIVVSCSDVNGAVASASITYVENNNTEVVVEPVSANIVIGLSIVDGKVIANVTDLDGNTLADKLLSVSIDGVPVLGAKTDENGIWSIDAEANSTVAVSCSDANGAVASASIAYIENNKTEEIIVPVPVPVPVVANATISLSTEDGKSIIANLKDLDGKAIANATLNAKVNGIEQNLTTDANGIATIPVSANTTVEVSYTDSNMATVTSSMSLTVIETIVEINKTIVVPPIRNASQIVCSDMNTISVAQEDGRVGEYFNVKLVDANGKPLANKFIQIGFNGRVYDRTTDENGSTKLQINLAYKGTYTFAIAYLGDDNYNGSFVVSKIKVTQQTPSLKTSSKTYKTSAKTKALTATFKTVGGKPISGKTVKFTVNGKTYSGKTNAKGVATVNVSLNKKGTYSFTVKYAGDDIFKAVSASGKLTLK

SEQ ID NO: 5931 - protein, 440 aa, Methanobrevibacter ruminantium
MESQSILIKNASILNPIGDGKTEEFRKDLLIVDDKISQIDEDIDESNADKIIDASDKILMPGFVNTHTHISMSLLRGIADDLELDTWLNDHIWPMEAHLSEEYCYIGALLGACEMIKSGTTTFSDMYFYMDGVARAVDEIGMRGVLSYGMIDFGIEEKRENEFKENISLIKKHNNTADGRITARFGPHSIYTASVDLLERVRKEADKYNVGIHIHMNETLKEINDSKENHDGKRPFELLDSIGFLADDVVAAHCVWLDDAEIKLIKDNGVYASHNPCSNMKLASGAAPVAELLSQGICVGLGTDGASSNNNLDMFDEMKFAALLGKASTLNPKVLTAEEVVNMATINGAKALNIDAGTIEVGKKADIILVDANSPNMTPMSNTLSSNLVYSANGSNVDTTICNGRILMENRKMVTVDEELILSEAKRAIKEMKELREADE

SEQ ID NO: 5932 - protein, 551 aa, Methanobrevibacter ruminantium
MESKIIKSDVLIIGSGGAGCRAAIEVSNEGKEALIVSKGLSFRSGCTGMAEGGYNAALGLVDPEDTIEAHIKDTLKGGAYLNDPKLVDILVNESPKRLSDLEEYGALFDRQESGELNQRPFGGQTYRRTCFQGDRTGHEIMTALKEEILKRNIKTMDEVMITQLILDPAESFMPKVIGAVGLDLKTSETIFFQAKAVILASGGAGQLYPVSSNTTQKNGDGLAIAWNAGADLIDMEEVQFHPTGMVYPDSRKGVLVTEAVRAEGGKLINSEGERFMGRYDDRMELATRDVVARSIYNEIMEGRGTEHGGVYLDVTHLDGELIEEKLETMLEQFLDVGVDIRKEPMEVAPTAHHHMGGLRINPDASTNVENLFGAGEVCGGVHGANRLGGNALADTQVFGKIAGSSAASATDIAEFRYNNEAVEDEENRIKSLIKEGSINPLDMKKEIQNLMWEKVSIVRNEQNLKSALERLLEMKNELNDLNVDDRTQFNESLITALEVTNMVEICILIVKSAILRRESRGAHFREDFPETNDTWKKSIVMSKSKIRFAKR

SEQ ID NO: 5933 - protein, 213 aa, Methanobrevibacter ruminantium
MNQEERLKGSPIERVETALEAIKAGNGVIVTDNEDRENEGDMIFSSEHLTEEQMALLIREGSGIVCLCLTQDKADALELPLMVENNTSTYGTGFTITIEAAEGVTTGVSAADRVTTVKAASALDAKPSDLHHPGHVFPLRARPGGVLERDGHTEATIDLMRLAGLNPCGVLCEITLPNGTMARMPDVIEFSAEHDMPVVTIEDIIAYRKENDI

SEQ ID NO: 5934 - protein, 127 aa, Methanobrevibacter ruminantium
MSLKSKAKKIGKAVIFVKLFEDLMANKDKREEDIAKLRIHIEEWKAEAPDDLNAILAAILMKAPDSSPDEIKAEFEQAKAEYHAEDEDILPWFESQIENITKEGEEAEEEAEEEAVEVEVTEEEPEE

SEQ ID NO: 5935 - protein, 78 aa, Methanobrevibacter ruminantium
MDNKFIILLCLVTVSVFISASFAFGNVLSNADNGSVQTYNSHKDISSPNMDYKHPGELIYGGCGGNQNIQTDGHICEK

SEQ ID NO: 5936 - protein, 54 aa, Methanobrevibacter ruminantium
MNLISVIIYLIILIFGVWVLYRGYKKGMEFGKFQYAFIVCLSALFICLLYSLFN

SEQ ID NO: 5937 - protein, 248 aa, Methanobrevibacter ruminantium
MGPEDTIYESQSLEDTIYKRKSVRSYEDAPLDNETINEIRDFIENANPLNPNIEWSYEILPKEKISTMMRWKAPHYIAIFSEDKENYYQNIGFIFQQVDLFLQSKGIGSCWIGMGSPKDYKNPHGHKFIILISFGMSERIYREMNQFKRKDIDAISDNKDERLIPAQFAPSSMNTQPWYFTHNDDGSFDLYRVKRGVLRNRFMGRWNKIDTGIALAHLYVANRDNFSFYMKDNPKELKGHIYDGSFEI

SEQ ID NO: 5938 - protein, 223 aa, Methanobrevibacter ruminantium
MDNKLFLQAFSKFFIGLIIICALLFIPAGTLNYPNGWLFIALLFIPMFFAGIIMFIKSPELLRRRLNADEEEEEQKIVILISAIIFLLAFILAGLNFRFGWFKLNSLIIIIASVIFLLAYIMYAEVLRENEYLSRTVEVNEGQNVVDTGLYGIVRHPMYTSTIFLFLSMPLVLDSIFSFIVMLIYPIIIIFRIKNEEKLLEEELDGYVEYEKRVKYRLIPYLW

SEQ ID NO: 5939 - protein, 329 aa, Methanobrevibacter ruminantium
MKWKIGDVEIDNQVVLAPMAGVCDSAFRTIVKSMGCGLIETEMVSDKAVMYGNWKTKEMLYMTDYERPISQQIVGSDIESLTFASKYIQDNTNVDIIDINMGCPVTKVTNRGKAGSALLKSPDKIKSIVESIVDSVDIPVTAKIRSGWDKSCINAVEIAKIIEDAGASAITVHPRTKDQAYSGKADWSIIKKVKQSVNIPVIGNGDVRTCFDAKRMLDETDCDAVMIGRAALGNPWLIRDCVNYLDNGDLPMEVTIEERMDMLKRHVNLLLENKGEEFAIPKMRTHAAYYVKKLPRTIELKQMIFKMNTKEDLFNLLDDYVDSLDELKR

SEQ ID NO: 5940 - protein, 312 aa, Methanobrevibacter ruminantium
MEILKPEELKEKFNDPWIAPYEKVITMADGDKVELIEYHPCPSGSNWLLYQYQHSSELIIDAKRDGNKHTYLCKVGKKPLDLKASINAAGIEEVAIDEEKNEVKVTHGGLAGAGVGAGMCRGMGEGVKYIELLEVGGGSKEGKATVVTPKYEKLVIGIDDTDVKDAGATWTMAHNIGLQLKEEGYEYLDHIIVQLFPHNPHKTQNCVSIALTFAVLKEEKENLINRLIEILKHDTLSDKTAIAILEGIGIPPKLREYAMATKTGMMDVETAEKLAEELNIPLLAVTGEQGKVGALAALGLYDDVDEAVKVYY

SEQ ID NO: 5941 - protein, 143 aa, Methanobrevibacter ruminantium
MVKYNIGAVVAEFNYDITHMMLELAKAEAQVRDCEITKIVMVPGVFDMPLAIKKLTEADQEGRIDLDCIITLGTVIEGATDHDQIVAQHASRKIADLSLEWGKPISLGISGPGMTRLDAHRRVSYGKNAVEAAVKMCDRLQDI

SEQ ID NO: 5942 - protein, 395 aa, Methanobrevibacter ruminantium
MNYALMVYNYTTNLGNEIQTIAARRFLPKIDYYIDHEKINLFNEEDNVKMIMNGWYLDCEKAWPPSESIDPLLISMHFNTTSSNKERLKALLSDESIEYFMNHAPIGCRDYSTVEFLNEQGIDAYFSGCLTLTLDNGKTKEERELDKGQDYIVVNSEIADEIISFLKDKTDKKIYRIQQDMIPSFDTSFPESMPLWLYNLSSFYDYEEKLFMAENLLRIYENASCVITDRLHCALPSLALETPVMLLNNRGFRERFDGLSNLLLESDIDSYESNYNIFDVDNPPENPKDYLKIRKDLIEKSKKFTGHINNSYYSDISQREIFERNNLLLSRNAIGTRDYIRNVLKRMRQHEKDISKKEEIIKNQEAIIDKQKKMIDEMKGSNSWKITSPLRKIRK

SEQ ID NO: 5943 - protein, 516 aa, Methanobrevibacter ruminantium
MKDNNKKEQAEDLLIANKFPPMNDVSGIILAKRALLSGKRYDVCHTVIKEPLDNDFNEIAEEIIDNRIIIKNFEYEMSKKELNETFRNYITEGLKKLEETNPNYKTITTRSWGFQPNFLALEYKLKHPDTFWTAEFSDPLTVNIENKPRDRRFKLDNKEYIDRINNEIDKVNERTGQNLEHIKESDFIYLICEYIAYVFADKIRFTNPNQREIMLNQCPYDVKDMVMAKSEINPHPTLDEKYYHIKEVDYKIDDDCINIGYFGTYFGKRNFETIFYACESLNEDIRSKVKFHLFLNHGDNLKRLTGNLKISKNIIVNDKVSLLEFLNLSTKLDILLVNDTETKGNFEINPYRPSKIADYIGSGRDIWGICEKDSIMDGLDEIKYKSYINDFYSAKLTFNQIVKDSSKIDDGLKENPFEDNDYLAKRASAMSEDEIVELINENNYLKGRTNHLNHLFNGTRGRGLFADEAKKLNLKNEKLEMENKKLKKENKKYKKDLKYLKSSKGSLKYQIKKIVK

SEQ ID NO: 5944 - protein, 328 aa, Methanobrevibacter ruminantium
MYEIAVIPGDGIGKEVMEATINVLESLDVDFNFTYGEAGDECLEKNGVALPNETIQLAKNADACLFGAAGETAADVIVRLRQELNLFANLRPVKSYPNTNALFENLDFMIVRENTEGMYIAKEEEYTAEGAIARRIITRKASERIIEYAFQYAKDNNKSKVTGVHKANVLKISDGLFRDIFNEIADKYKDEIDSEDFYVDATAMYLITRPESFEVIVTTNLFGDILSDEGAGLVGGLGMIPSGNIGENGALFEPVHGSAPDIAGQGIANPLAMMLSAVMMLNYLGESEAEEKLNNAILELLNEGKCLTPDLGGSSTTMEVSEAIKSKL

SEQ ID NO: 5945 - protein, 160 aa, Methanobrevibacter ruminantium
MKGKVWKFGNDIDTDIILPGRYLIYTDEEKLSEHCMEGLDPDFKNKVSAGDFILGGTNFGCGSSREHAPIAIKGCGISAVIAESFARIFYRNATNVGVPLLEAPGISSAIENGEEIEVDMEKGIIISESGKEYEFKKLPPFMLEILEEGGLINYLKKQNE

SEQ ID NO: 5946 - protein, 425 aa, Methanobrevibacter ruminantium
MSTIAEKILSRASGQGQVEAGDIVMADIDIAMMHDLTGPLAVESFNKIGTERVWDNEKIVIPFDHQVPADSLDSANNHILMRKFVKEQDIKNFYDVYEGVCHQVLPEKGHVIPGTVIVGADSHTTTYGALGAFSTGIGSTDMAMVLSTGQLWFKVPETIQFNIEGILKENTSAKDVILNIIGQVGADGATYKSCEFKGETISTMNISDRMVLSNMAIEMGGKTGIIEPDNVTYQYLKDRVKDENKNRLKAFIEKSNLKTDEDSSSLETMDIDVSDLEPQIACPHNVDNVKPASELSDIEIDQVFVGSCTNGRIEDLRDAAKILKGKHIASGLRMLVIPASRETYMKALDEGLIKIFVEAGALVSAPCCGPCLGGHTGLIGPGEVSLSTSNRNFKGRQGSPEGEVYLSSAKVAAQSAIEGRISVPK

SEQ ID NO: 5947 - protein, 823 aa, Methanobrevibacter ruminantium
MEKEFFEGMNLEEDISDEDFQTIVEGWEKVQDQMSKEEFITKFNEHKAEFKDASFFSDIDFLNMIVNPLVGGGDDEPGPAIVEGEFQKISDVEPGNEGFNVVARIMSIGNSRIFTSRKGKQGKLCNLQIADDTGELRLVLWTENIKHLKHVTEGDIVEITNIECKEGFRGGKEFSLRPRSSLRPIEEGSENYPENIAAFPVYEEKITQIADIKPDETVSIIGRLIRVPKPHAYESNGKKGKVTSLEIQDASGKTSYTLWNNDVKLIDILELKEGDIVKILNEQSRERNGEISLSHWDGRIVKAEGDYDIPEYEENIIKIADAQEMQDVSIIGLVTKVQDVIQFTRNDGSEGFVKSIELSDDEGSIRVTLWGDDTKIPISKGDIVKVIGGNIEYDDFSNGYRVNTNWNTELKINPEEHSDLIETLKGQAENLGPIPISEVQSIEEDGEEVDIIGRIITLNDTHTFPRDDGTEGVVRSGEMADGSSPDGLVRVSFWDDKAKVPEIGKAYKVENARTRMGMYAVEVNVGKTTRFIEIPESEAGDLPSFEELEESIYISKKIEELDEDDMNIKVLARILEVHEPREFPRDDGTKGLVGNMEVADITGSIRVTLWDDKNNLPYGVGDAIKIQNPRVRYNSNMDYLELSVGNGTNILTPSDSEINDIPDILELQNTLYQTKEIANLSDDDTKIRVTGRFVDIYGQKMIIPKCPQCNNTLEPEDIDAEECSFCGNYIDEPKYLLMLPGKLEDDTGDIQVTFFNELVGELLGMKQDEIFELYEGEGGDLGPLEGKIDDLEGITLEILADVTFNEYDEENRLRPRKIFNMEW

SEQ ID NO: 5948 - protein, 311 aa, Methanobrevibacter ruminantium
MVELEDLPNVGEKTAEKLREAGFADMMRLATATAKELSVKAEIGEGVAEKVIEAARKAEKIDFETAFDVMERRRDVGRITTGSKNVDELIGGGIETQSITEVFGEFGSGKSQISHELAVTVQLPKERGGLEGECVFIDTENTFRPERIEQIADACGIDREEALQRIHIARAFNSSHQILMAEKINELIQSGVNVRLVIVDSLMAHFRAEYVGRESLATRQQKLNQHLHALQQIANTYNVAVFLTNQVQARPDAFFGSPTKAIGGHVLGHASTYRIWLKKGLAGKRIARLVDSPHLPEGEAVFKVTTDGIVD

SEQ ID NO: 5949 - protein, 660 aa, Methanobrevibacter ruminantium
MAEEINNEEIRVGVYVCHCGVNVGGVVNCPEVAAYAETLPNVVIAKDYKYMCSDPGQSLIQEDIKEHNLNRIVVAACSPRLHEPTFRRCVEEAGLNKFLFEFANLREQDSWVHMTQPEEATAKAKDLTRMAVAKARLLEPLEASKVAVDKKCLVIGGGVAGIQSALDLADMGFKTYMVERNPTIGGRMGQLDKTFPTLDCSMCILAPKMVDTSKHENIELITYAEVKEVDGYIGNFTVTVEKKPRYVKEDDCTGCGQCQEVCPIEIPNYYDEGVGMVKAAYIPFPQAVPLCATIDKNYCIDCGLCETVCGPDAIDRDMEPEEIELHVGTIIAATGYDPYDPTEKYEYGYGRYTNVITAMEIERMINASGPTGGHVQKPSDGKEPKRVAFIHCVGSRDEQIGKSYCSRVCCMYSMKNAQLCIDHEPDTEVTCYYMDIRSFGKGFEEFYKTSQEKYGIEFIRGRPAEILENDDLTLTVRAEDTLLGKVTEYTYDLVVLSVGLEPPKGSNELRQTLGLSRTTDGFYMEAHPKLRPVDTLTDGVYIAGVAQGPKDIPDAVAQGSAAASRASIPMAKGEVEIEPITADTDTTVCGACEVCVELCPFGAVSIEGEGADKHAAINVALCKGCGTCVGACPSGAMNQNHFKTEQIMAQIAAALEDVAK

SEQ ID NO: 5950 - protein, 221 aa, Methanobrevibacter ruminantium
MKKFESVDFDKTEKIVDGIAIEDNEAMDIVVILEPGSGQYAFLASRKAPSKGFNAFIETEAAKDHKTFVTAVLFDNEYEILHSRRDINEVPILTTNEYSCRGCTALYDAIGITIESIKDEIDNKVLFLIITDGMENASRRFNEDQIRSYIDELDYEFIFVGADIDSYREASKIGIRQSHTASFKKTGEGIDDLFKTISDVSDIHRDNMKLEDVDWKHRLED

SEQ ID NO: 5951 - protein, 498 aa, Methanobrevibacter ruminantium
MVKRIPDEEQIKLGIRTLDFNIPEDHISRFVVDFIDEYYPLLGIKENKKKKGRDSFPVKEMLKLLIYAKIEHIDSMRFLADMVKYHDVYKFVGNGICPSERSLQRYREKYGKYYNELLKATLKKASDVDYTDFNEVSIDGTIKKAYNSKNKVITEKETEILTRYFEGGRVSQEELDKLHKPAREILENKKISNQEKLYLLDDIKTQFTLSGQKSVPVTDIEARWMKSKKGNSQISYNIQSAVDYDTKMICAINVVQAPTDHYQLPKIVDKAINNTNVIPRFVLADTIYLNEESLSYLADNQINGVIPDRKQSKEKIGRLNKNPYHKDHFKYFPEIDAFECPEGQIMYFFNKYTEKNDDLDKPDKIKRLYSNYGACKACNCRENCLSSTQTHRTITEYGGSLKKAMWEKMETEEYKEEYAKRSSVEGPFGILKEQFHIESEVVIGKTKTEERILLDAVAYNLIRLFNLEQEIKNDKEDIVDFCEKISVQEKLEVRATIF

SEQ ID NO: 5952 - protein, 97 aa, Methanobrevibacter ruminantium
MSFEDLIEDYVKAKIDLNVKFGSVLDELNIEYESFCFYDEFKSVCLDLEMHNKELSDEEIENIIEKTGFDFLKVEIKGKKFPFGNGEEIDYTYVFEC

SEQ ID NO: 5953 - protein, 332 aa, Methanobrevibacter ruminantium
MKISLNNVSLDIDLKNSQKFKNMEVIPIEALSAGKKEFITLKAGIQEGYVKISECESSTVNTVMAQNKSSTPLVLIDGEEVIGAMQNRIMNRSLIVPGNTTMPISVSCTEHGRWHTRGNSPKAREFSHSDFFADYETRHRKSETLYNNSDCQSEVWASISDLEIKNSYRSPTSALNDSYVHHRPRLNEYLKHFSMLYNQIGAIFIINGQIKGLELFYNPFLCSQYYDKILKSYIMNAITNYYSNCSSNSSNIDVGAFLADLSDSKLNHSPNQGLGQHIKFSNNHGTGSALINDGEFVHLNYFKTKYDVSYKKQRKNVRTFGSFDDLLSKMDE

SEQ ID NO: 5954 - protein, 423 aa, Methanobrevibacter ruminantium
MYQYENEVTKLNELMETHNNWMRDSVNLIASENTTSNAVTGAVASDLAHRYAEGQAFERLYQGCTYIDEIEDIVKRLSREVYDCSYANVQPVSGVTANLAAFFGFAKAGDKMMAMNIPFGGHISHANVSAAGIRGLKTLEHPFNPEVMNIDIDAMNKMILEEKPKIILFGGSLFLFPHPVKEAVDAANEVGATIMYDGAHVLGLIAGKQFQDPLKEGAEVMMGSTHKTFPGPQGGIILSDESNKELIDNAVFPGVVSNHHLHHLAGLGIATAEMLEFGEDYAKQTIKNAKALAGALAEQGFNVFCEDLGYTESHQVAMNVSDVKRATILAKELEQNNIILNKNLIPGDNVNDSDDPSGIRIGTQEITRRGMKEKEMEEVAEFIWKVAEGDKVDIKDEVTEFMSQYRTIHYAFKEEEGYKYIQY

SEQ ID NO: 5955 - protein, 233 aa, Methanobrevibacter ruminantium
MRIGWAFTGAGHLLRESVEAMEEVAKYHDITVFLSQASEEVLRMYGLYDRVVAVTGGRYRELACDSNQKFSFPITGRLSLGKYDALIVSPVTANTVAKIVYGISDTLVTNAVAQAGKGRVKTLMVPVDIEPGDVDTVLPSKLELSKCQKCDVCDAAEVCPNGAIVAHQEIDLLKCIGCGACKDICQYGAVSAGKIITMHMRDIDIENTQKLSKMEGIEIFASPQELLLHFDYK

SEQ ID NO: 5956 - protein, 133 aa, Methanobrevibacter ruminantium
MKNNRKNNQNKENNHLKSLHLKKSNEKITDLRIADSFLSRFLGLMFKKDIDYPLLFKIPQNINNRHRSSIHSCFMRFELKLVFIDKNNIIYEISDLKPWRYYAPKKPAKYIIEFDKNGFSDYDLKIGDEVELK

SEQ ID NO: 5957 - protein, 402 aa, Methanobrevibacter ruminantium
MSRNIFVEKLNQTFIEDLDIEIVERKGIGHPDSISDGIAESVSEALCKMYMDELGGVLHHNTDEVQITAGESNPVFGGGQIIKPIDILLTGRGVSEYEGHKLPLDYVAIDAAKEFLDKTVINLDVNRDTIVECKIGHGSGDLVDVFKREGAPSSNDTSFGVGYAPFSEVETIVFETETLLNSKAFKKDHPGVGEDIKVMGLREGDKITLTIGCATVSKYLANREEYIACRDVLKDIVADLAVKYTDREIEVFVNTADNDNATDESGYYLTVTGTSAEMGDDGSVGRGNRANGLITPCRPMSMEATSGKNPINHVGKIYNILSNEIANDVAKDVEGVKQINLMILSQIGKPIDQPKAASAGIILEDGYEMGKVSPQVEKIIDNWLENITDITEKVVQGKARTF

SEQ ID NO: 5958 - protein, 1143 aa, Methanobrevibacter ruminantium
MPIEEAEKSYDFKKIESKVQSFWEDEDIYQKTNELNKNGPQYSFLDGPPYCSGKIHLGTTWNKVIKDTLLRYKSMNGFALRRQAGWDTHGLPIEHKVEQLLGIESKQEIEEKYGIDKFVGKCKEFAMENKVAMTEQFKSLGVWMDWDNPYMTLDPKYMESAWWTLKKTHEKNLLTKDKRVISWCPHCQTALAAAEIDYTEDTDPSIYVRFPLKEKFLNEENCSEFANDSDLANLKQSFLVWTTTPWTLPGNLAICLNEDFEYSFVKVDERLNESDDEILIIANELLETVLGPIEIIHKNKIPNPKYDPENKESKEKKYLIEEETEVMYEIIKTVKGSELLGLGYVYPLAEEVPKQMEIEAENSLVHTTFHGDHVELGEGTGFVHTAPGHGPEDFEIGQEVGLPIHCPVDEAGCFTEDGGAYANGYTKDLNDTIIADLIAKGLMFKNDTITHRFGVCWRCKTPIIYLATEQWFIKVPEIKEKMLSEIDRVEWVPKWAGEGRFHDWVANAKDWTISRQRYWGIPIPIWVCPDCGEIKVIGSVEELKELSINEITASDEELVHRPYVDDILINCDCGCDSPMKRIPDVLDVWIDSGVAGWAALYYPREEEMFDKWYPYDFICEGHDQTRGWFYSQLGTGVIALDQAPYNKVLMHGFVLDEEGKKMSKSLGNVVQPEEVIEKYGADVLRFYLLWACKPWDDLKFVWDELNNVKKMFNILWNVYVFSTTYMALDEFDPAKCVLDGPDANVTLRNEDRWILSRVNSLAKEAGDAINDVHFHLATRAINNFILEDLSRWYVRLIRGRTWVESDDPDKLGAYYTLYNTLNTLIHLMAPITPHLSEEVYENLVKNLDDNAVESIHMDNWMFDECLIDKELEAEMDHIREIIEAAARARDVARYKLRWPVSDITVVSQDESILNSVALLEDVIKDQSNTKEVLTANEFENLTFIAKPNLKTLGPRLKGDMGIVQKFFAQAKAEGIGNSIKEELDSSGKYIVTGEDREGNQKEIELSADDVLYETELPDDVVSAEFNGGNVFVNTKITPEILSEAMARETIRRIQDMRKDMDLDVEANVGVMINTDGEFKELIEKQSNLISDEVRAKSLVIFDGKACEVCTDKGMGREYEDISVEYSKEWEIEGHKVIISVVKL

SEQ ID NO: 5959 - protein, 736 aa, Methanobrevibacter ruminantium
MTLTDSEVKYIEGILGREMNELEEGMLDVMFSEHCSYKSSRPFLRMFPTEGENIVLGPGDDAGLVSITDEYALAVGMESHNHPSAIEPYGGAGTGIGGILRDIISMGAMPIALLDSLRFGPLEDQKSRYLFEHVVEGISDYGNRVGVPTVAGEIEFDESFRTNPLVNVLCAGLVKKDEIVLAVAPNIGDVFLLMGGTTGRDGIHGVTFASEELTSDSETEDRPAVQVADPFTKKRVLEASLEILEKIDCSGVKDLGGGGLTCCVSELVDKSKNGAVVDLRAIPLREEGMTPYEIMLSESQERMIFVINPKDVELAQKICDKHEIPSAVIGEVTEGSNMVVKDFDAEEELQTLCNVPTILLADPPSIDRPTVEPAKSEDLVEVIDGPIDESLIKILSSPNIASKAWVYKQYDHEVQTRTVVKPGDDAAVLQIDDETAVALTADSNTVHTKLSPYDGGAGSVAEAIRNVVSMGAKPYAIVDCLNFGNPETPEILWQFKECIRGMSDIAEKFEAPVISGNVSFYNETEGIKINPTPAVGVIGVEKLSSIRTLPFKNEGDKIIIIGKTYDELGGSEYHRAVHNLEQGEAPKIRIDDELAAANAVLDLIENDGDYVKFLEGEDKLNIKATHDVSAGGIAIALSEMVMKGKLGCEIDISNVPAEENISDNDLLFSESHGRYIIAVDADKAEEIVNSIDIDAAIIGEVKGDSLIIKNNDETIVDFAIDELDNAYNGVIEKYMA

SEQ ID NO: 5960 - protein, 408 aa, Methanobrevibacter ruminantium
MKFISNLIPLEEALSKINDNIKLMDTETIDLKDSQGRVLAHAVSSYHNSPPFDKSAMDGYAVIAEDTFGASNNVIKELKIIDRIGAGDFSNKSLQNGDAIVIATGAPIPDGANAVLMKEYTYEDGDNLEIHSQVTPGENISPKAEDIAKGDEILGENVLIRPQEMGLIASAGYSEVEVYKRPRVKLLITSNELVDPSPNIDDAKIINSNQYTIAALIRSAGATVDIDHGIDDFDEIRDAIDKASREYDCVITTGGTAISKGDVVIDAVEDLGEVLFHGVAMRPGKPVGAGIVNGTQIFMLSGQPVAAMGQFDIIARHFLFKVQGLDYSHKIVKRTSSTKIHSSLGRTDYIRAVADDETVHHVLNRGSGIIRSMVEANCYIIIDENHEGIEIGDMVDLIFFNDMAWPSL

SEQ ID NO: 5961 - protein, 219 aa, Methanobrevibacter ruminantium
MNKKIIFLACVIGIALLSVSYISAESDVDTSDWVNITVNDINFQIPPEYGGGRNASGDYLFNNVFTFGLVALENNKSFRNNYGYEATNEENYDVEEMEIDGHHAVAYYSNRSIVNHTVTYLYFESNGTFYALSYDGDDVNSSMKKIVSYSPKSKLSKEEFNEKLNKAQEEYIEDQIEQEEAYQYEQAYREGYNQGRSDSRGGELLGYYFFYKLGQRSRY

SEQ ID NO: 5962 - protein, 408 aa, Methanobrevibacter ruminantium
MKAKAEKIGDGVYWIGVLDWDLRTYHGYTLDGTTYNAYIVFGEKVAIIDNAYPGKTEEMMARIDDAFEQEGREIKVDYIVQNHVEKDHSGVLYDLWKRFDAPIYCSKIAQGGLLRHYPKLEGAEFNIVGTGDALDLGGKTLAFLDAFLLHWPDSMFTLLAEDGILFPNDAFGQHLCYSKRYDKDIPEYVLMDAAQKFYGNLITPLSKKVLNKFDEIIELGLLEQVKMIAPSHGQIWTDPMKIIGAYSDWATGKRAEDKVTIVYDTMHYSTQKMAHEVAEGIMAEGYDVEMFFLHEDERSEIVKSILTSKAVAFGIPTINDFPFPSIGDIIYYLKGLHFNRTGFKRPAVTFGSMGGRGGAVEFIANELTECGFEVLDQQEIYYVPADEDDEASFKLGQKLVEEAKKLEL

SEQ ID NO: 5963 - protein, 264 aa, Methanobrevibacter ruminantium
MENEENISQPKAIQIFAKAPGELGVNVVKSPVKLTILSMLKDTDMEFDEIVKNTGKSKSTISVHLKSLREDGIVSYRFDANDHRKKIFYISSKFLGEVESGDEKELEERQAEFLVKNILDVDNFKFSFLLFHTLRSNLIQEGININPVLNQTGKNIGAAMYEKLYDDDIKVFCDNITEFWADNGLGKLDIVLGDIINVTAYECFECSLLPKKGKPACYLDAGIFEALFANYLKKDIAVTEVKCFTMGDDCCHFLVEGINGESLT

SEQ ID NO: 5964 - protein, 660 aa, Methanobrevibacter ruminantium
MSNSIFCPDCGMLKENCVCGRYKANRDKVKYTKGTRSNPQYKKRKTFNYSNKKRAENMKNTSSNKSKGLFQYEEPKGLYQYEDLEPVKVEEEDDFGSSKVYDIAEHDLPKEIIDGLKEDYPEIPDSIIENFPFERPREGQLDIIADIEEAISKGFKYIILEAGTGTGKSAVATTLARMYESAYILTMTKQLQRQYADEFDFPLVKGRGNFDCIKDGFEVTCDMGACKTAPKNSKFFCPYGISKNPTLTGDLAFQDSYGGDIFFQTNDHCHYWQQKANAINSPITLMNYDYAILELNYVKHFGKRTLLILDEAHNIEDKLMKTMEINLYNRQLEKDIKKVISPQTLKTREMGEWIMEIDAIQGHYADIDIKDLPTNKADRIRSTSARLKDLKNKLETEPGNWVIDSNENGVSFKPLKVNHYANDYLFKHGDVVIFLSATILSAKMFSKWLGLNPHEVYHIKVDSPFSVEKRPIELNLAGKMSKNRVKQSAPKSIEILNKILKRHEGDKGLIHTHSYKCQQYIINNLYNSRLIAHGSNNRERVLKYFEEDDNPLVLVSPSMSEGVDLPYDKCRFQVIYKIPFPYLGDPQINMRRKKDQRWYAYKTVMTLMQAYGRGMRAEDDSCVTYILDSDIQMLLKSPLYRSLIPEFFKEAIIVNDDRII

SEQ ID NO: 5965 - protein, 232 aa, Methanobrevibacter ruminantium
MVIKEKIEIEGIPVEVHRKRMKNVYLRVLPDATLRVSAPERVSNDYIIEYVTSNLDWVKQTQERILKNPPKPKIMYKNGEVHKIWGEEYKIQLITNDTIKHAFYDADESIVYLPVRRRSTVNEREKALFELYRSEMKRNIDCFLNKCVPIVGEQPKEIKFRNMKNWGNCRRNKTITLNIKLASKPPICTEYVLIHELCHILEFNHSPRFKALMDGFCPNWREIKKLLNESDD

SEQ ID NO: 5966 - protein, 277 aa, Methanobrevibacter ruminantium
MLTKRIIPCLDCDLQVPEGRVVKGVEFKQIRYAGNPVELATKYYEDGADEIVILDITASHERRGTMVDVIERLTENVFIPICVGGGIRKVEDYTRMLKAGADKCSTNTAAIHNPQLLTDASKVVGSQAVVIGIDAKRRYVEEDPEQAKGKTIVDTDDGEVWFDCSIYGGREFTGMDAIAWAQECQDRGAGEVLLTSMDGDGTKDGYDLILTKAINDNVDIPVIASGGVGNPHHILEAFEIADASAALAASIFHFDEYPVPVVKKYLKENGVPIRETF

SEQ ID NO: 5967 - protein, 358 aa, Methanobrevibacter ruminantium
MSSQKINSLIDLNLTQYSGQTSQSPWRHNSMENIDKFDELIYLKVPSIIDGLDDKTINLNGLPVLLNLSQDKDNINGFEYTYSLPQKVEKQAFSIGQDNLSKKELQSIEREIDSNLNNIYDLEFDLEKFYEFLLEDEKLAPSVDFCKGLRLFIAKDPFECIISSICSANNSIARWTASIDKIKLNWGEKVEFDEGMFYGFPSPKDFLDFYETPIEQSEADGRRYEVDCYTKNLKSCGVGYRAPYMKKASQMLIDEIDMNDVSKMAYDEAFDLILRLPGVGPKVADCILLYGFGFQEAFPSDVWIKRIVSHLYFDGEDISADKTREFGIERFGDYAGYAQLYLFHYARKSGLMDEIKNK

SEQ ID NO: 5968 - protein, 147 aa, Methanobrevibacter ruminantium
MKLVIQRVTNASVEVEGEITGQIEEGLMVLVGFGQTDTEKEVDYLARKLTKLRIFPDEEGRMNRSVKDIGGKLLLVPQFTLYGRTKKNRPSFHKALAPNEATKLFDYFVEKCSEEVPCETGVFGAFMKVSLLNNGPVTILLEKEFED

SEQ ID NO: 5969 - protein, 149 aa, Methanobrevibacter ruminantium
MNGESFQGIWDNSPLIAWIHNLSKNHFKYLKAKINEFDLGHEIRYIMMIYDNPNISQDDLVIMSGQSKGNIAKSLKKLEDDGYIKREVNPENRRKYMLRTTSKGDELVPKVRQISKDWEKEVGITEDDKEVIERIKEIAINGMKLTEDL

SEQ ID NO: 5970 - protein, 338 aa, Methanobrevibacter ruminantium
MNDLTDRLFHFFKEEIIFSISLILAIISCFFVPPSVDYLNYINWETIILLFIIMLFVEILKNLSVFEILVRKLLKKVKNTRGLVLFLVFTCFFSSIFITNDVSLIIFVPFTILALRKVDRLDLIIFAVSMETIAANVGCMVLPIGAPHNIVMYMVSHIPFQSFFLILLPYIVVSAVFLIILSFFVPSDAVNLPKFGKVEINKEGFFKRVLFGVDYFLLLTFIALFVLIGNLENITFFNLLFKKWIIGNEVIWGVVASQFISNVPAAILLSGFSTNYEAIIVGINIGGLGTLIASMANLISYKILVREHGEFKIRYLIIFTFLNVVLLFILLGVYVFIH

SEQ ID NO: 5971 - protein, 196 aa, Methanobrevibacter ruminantium
MLFEKENTEEKIIRATFDIVQREGLQKATTKKIAAEAGVNEVTIFRKFENKKNLIKKTKEYYTNQLIAKLEESFEFNETDSIEEYLKRSFNKILEFSEEDFNIIRVAMQEVKNDDDKKLLITTITDTIINKLDEFFKLQLEKGTIKDLNSKAVSLMCFSIIFQSLILWQIYNDGDLAADYYADEFLDIIFNGIKVQ

SEQ ID NO: 5972 - protein, 45 aa, Methanobrevibacter ruminantium
MARCPRCGSEALEEINFNTYKCHECGYMIRNPDDLELVERENGDL

SEQ ID NO: 5973 - protein, 142 aa, Methanobrevibacter ruminantium
MKKAIIETEKGDIVLELFPNEAPGTVANFEKLANSGFYDGLTFHRVIPDFVIQGGCPRGDGTGGPGWTIKCETEGNPHKHGTGALSMAHAGKDTGGSQFFITHSPQPHLDGVHTVFGQVIEGMDVVNAIRPGDKMLKVTVQG

SEQ ID NO: 5974 - protein, 91 aa, Methanobrevibacter ruminantium
MLEQYMQFMWLIIFGNIENLILSSQGVVQGVDPKILGGLSILVVIMWFVIGTVITDVAIQYSNLINFIGGLAIFLLGFQAVYEAVRNIRGG

SEQ ID NO: 5975 - protein, 346 aa, Methanobrevibacter ruminantium
MARIILGKTGLEIEKNGFGALPIQRVDFNESAEIVRKAYNNGINFFDTARAYTDSEEKLNYAFKGFDKEFPRESIIIASKTQGENRRDIEKDIKTSLDNLGTDYIDLYQIHNPSFCPTEGDGSGAYDALFDLYDEGTIRHIGFTSHKYELAEEAIHSGLYETIQFPFSYLTGPKELAIVEMARANNIGFIAMKAMSGGLIRSSKAAFAYINHFDNVVPIWGVQKLSELDEFLSYMADDTKLDKQLEEIIAKEREELQGDFCRGCGYCMPCPEDIQIFICARMSLWIRRFPAEPNLNEETQEKMRKIEDCTECRQCVMKCPYELDIPELLKKNYEDYKKILSGEIKV

SEQ ID NO: 5976 - protein, 391 aa, Methanobrevibacter ruminantium
MNTQEIIDIEDKYFINTFNRVPIVLDHGEGVKVWDIDGNEYLDFLAGIAVNCLGHNHPKLVSAIQEQAGKLIHVSSIYYNEPATVYAKRLVDATGFDRIFFANSGAEANEGAIKLAIKYSGKHEVLYCGDSFHGRTILTLSVTDHPEYSAPYVENLPKGFKKVEFGNLDSVKEAITDQTAAIIIEPVQGEGGVHVASEEFYKGLNDLCKEKGILIIADEVQSGFGRCGALFAHELFGLEPDIMTVAKGIGGGFPMAAFLAKEDVAGGFVPGDHGTTFAGSPLAGAAANAVFDAFEEENIVENSKKMGEYFKEKLAPLKDKYDFITDVRGSGLLVGLELNFEGADIVGKMLEEGFLINCTAGNVLRFAPPLVVKEEEIDALVEALDKVFSSL

SEQ ID NO: 5977 - protein, 145 aa, Methanobrevibacter ruminantium
MTNRKDWGLTVRGIVQQEDKILILRRHPKSRNNPNKYELPGGKVDPGEFFDEALIREFKEETNLDVNIVSLFETVQDEFISRRTNQPISTVQLMMNLEIMGGEVEISSEHDDFKWVSIEELKELYKNDMVTPTLRLTLEKRDFKI

SEQ ID NO: 5978 - protein, 427 aa, Methanobrevibacter ruminantium
MDLNIKTNDKGHLDIGGADACELVEEYGTPIYVIDEERVRDNYNRFYNAFTKFYPKFKVFYACKANTNIAVLKILEEEGCCIDAVSPGEVYICKKMGFSGDRILFTGNNIRNDEMDYVNSEDVILNIDSVSALKRLAESIDPQGKKISFRVNPMVGAGHHGHCITGGEMSKFGIMETEAVEIYKLAKELGFEPVGMHSHIGSGILDPEPFKLAIESTMNIAGKVHQEAGIDFEFIDFGGGVGIPYTPEEELLDLEHFAEENIKLFKEKLEEFDMGEPILYLEPGRYIVGDASVILVEVNSVKESYRKFIGVDAGFNTLLRPAMYDSYHHIVVANKMNEEPTQTVDVAGNVCESGDLFARDRPLPDIEEGDILGILNAGAYGYTMASNYNSRPLPAEILVKNGESFVIREAQTFDDIFEKQSIPEHLK

SEQ ID NO: 5979 - protein, 287 aa, Methanobrevibacter ruminantium
MVDLKGLKFSKMHGIGNDFPIIDESKGEQIKEADKPEACRQLCHRNFGVGGDGVLFVVPSDVADIGYRMFNPDGSEAEMCGNGIRCFGDFVYRNKIVEKETMTVETKSGIKTIEITVEDGEPVLFKVNMGKSTFKVPEIPMIADTDEFVDGDLDVIDTTFKATCVNVGNPHAILFVDNVDDIDIDKYGPAIECHEVFPEKINVHFVEVLSKNEGKMRTWERGAGVTLACGTGATSTALAGVKLGLFDKNVLLHLPGGDLEFEVYEEDGELGAFMKGPAALVFNAEIQ

SEQ ID NO: 5980 - protein, 56 aa, Methanobrevibacter ruminantium
MILSRNILNYLKEGKTLEEACAKAGVVQNELNIWKLWADKGLQPYKDFFREIENYR

SEQ ID NO: 5981 - protein, 242 aa, Methanobrevibacter ruminantium
MNLEERNSREIEEFFKSKGVKVVGFASLENIRNVPKEYPNSILIGIPIEKEALKTIYTNDQSLYVESMKEVAQKLNDIILEGEDYIKNTMNYNALAISRERVAGELKDLASKIPHKTTGTRSGLGWIGRCALLISPEYGAALRLSTLLTDMPIKVGTPIDDSLCEDCTDCQDACPVDAINEVKWNSRREREEYFDAEKCFEFIKKEMKRTNGKSLCAKCGLACPYTKEYLGIETDRNLIKEI

SEQ ID NO: 5982 - protein, 216 aa, Methanobrevibacter ruminantium
MKTKNTKTRPQLTKDLKSEDFMEYYFLKEELKEFCRREGLKIGGSKNQLEERIIYYLDTGKSLDESVKDGNKTKNHKSVKDDNKTKNCNHKISNSDSQEITLDSILGENFRCSEDKREFFEREIGKGFKFKVKFQRWLKANPDKTYQDAINAYYELQNSNEKTKIDRQFQYNQYIRDFFEDNEGRSLDDAIKCWKYKKSLKGHNRYEDSDLKILKS

SEQ ID NO: 5983 - protein, 194 aa, Methanobrevibacter ruminantium
MGKFEIETDDLVYIPSDDTFLLAENLEIKEGQSVLEIGTGSGLVSMYASLLTDDVTATDINYNALELAEKNFKLNDINTIRLEFGDLFEPVKNEKFDVILFNTPYLPTDTDDIIDDDLNYAFDGGIDGRKVIDRFINEVSHYLNDGGIVQIIQSSLSNNDKTLDMFDRNGFIAEIAKSESFFFEEIVLINAYKI

SEQ ID NO: 5984 - protein, 298 aa, Methanobrevibacter ruminantium
MKEEISLAKQTKRILQENDIKLNKNLGQNYLIDDFKRKKIINYANLTKEDTVLEIGPGIGTLTIELAKRAKKVIAIEQDETIFNILKKRLEKEKINNVELINGDAVKVDFPEFNKIVSNLPYQISSPISFKFLNHDFDLAILMYQKEFADRMNGKVGTKQYSRLSAMLYFKADVKFLTKVSPESFIPSPKVDSAVIQLKPKNIDSIRINDKEYEIDKETYKTYSKVVKALFQHRNKKARNALIDSRHIIGFKDKKELKSILNDLEDENPRIKEILLERTINLAPEEIMELTILLKDQL

SEQ ID NO: 5985 - protein, 249 aa, Methanobrevibacter ruminantium
MDNPNIDNPAPKKEENVIILDYLKFGYINPERPTARGKPIAQALGVDKFTLIEVTPKQGIDLEIHEKVYIGSGKRDKINRVKGLLDYEKLTATSRIELEYAIKEIIQSKEEIYIKFFNEIDSLNIKMHKLELIPGIGKKHTQMILEERKKEPFKDFEDLKKRVPLLGDPVDMLAKRVSLELDTTQVKRGKKKYYMFTQVPSKHPSNKKRYRRGRNNRNRNNRNRKPNKNRNKKPNNKANNKATNKPKTE

SEQ ID NO: 5986 - protein, 114 aa, Methanobrevibacter ruminantium
MIGKKTLESEPIPAAKVKEILEEFSEKYELNYEQNLTLAHVTNLNKLSLEDAEKLIEELEAFMTHKQAIRVADLLPRDMADLRLIFAKERNAPSKEDMEQILEIIEKYEIYVEE

SEQ ID NO: 5987 - protein, 96 aa, Methanobrevibacter ruminantium
MQRSRGFKSRSRKKLTKKVRPGRANPITRRIQQFENGDMVHIIIDPSIQKGQPHSRFHGKTAKVVDKKGKAYILALKDGNKAKELIVTPEHLKLQE

SEQ ID NO: 5988 - protein, 422 aa, Methanobrevibacter ruminantium
MNQEILNKAEELINHTNGNICNHCLGRKFSDCVEGDGNEDRGAKIRQALNLEPYKANEDNPANDEKCLICNDLFEDLNTVLDLVNEKIDLLKVEFDTFVVGCKLPKEIVEKDQEISDEFDFNVEIIKKEVNREIGKLLESNLEQNVDFDGEDVLVMVDFRRILKEDIENPIKVRLQINPIFIEGRYRKLIRTIPQTKWPCRKCKGKGCEECNFTGKQYPESVEELLSEVVLKHTNGYEAKFHGAGREDIDVRMLGTGRPFVLEIKEPKIRKIDLKKIEEEVAISAKGKTEYLNLKFTERRRKAEIKESSPDTYKVYRALVKCEDYIKEEDLEKLQTLHIIQQRTPIRVSHRRADKIRQKEVKEIKAEFIDSKTFEMIIKTEGGLYIKELISSDEGRSNPSVSEVLGTQAICAELDVIEVGIK

SEQ ID NO: 5989 - protein, 444 aa, Methanobrevibacter ruminantium
MLGSLGENLTNTMKKLAGMSVIDKKVIKEVVKDIQRALIQSDVNIQLVLKLSKTIEKRALEEEPPKGITPREHVITIIYEEMVNLLGSEAQELKITEKPFKILFLGLQGSGKTTTIGKLCRYLQRKGFSPAVVCTDTWRPAAYEQLKQLTEEMQIQLYGDPDNKDALDLAEKGLKHFKNQKIIIFDTAGRHKNEEDLIEEMNKLDKIINPSESMLVIDATIGQQAGEQAKAFSQATDIGSIIISKLDGTAKGGGALSAVAETGAPIKFIGTGEGIDDFEAFDPERFISRLLGMGDIRSLIEKAEEVIDEDEATKTMNNMLSGKFTLVDMRSQFEMMNSMGPMQQVMNMIPGLGGKIPKEASQMTEDKINGFKIIMSSMTEEEMLNPKIIKQSRIQRIARGAGVEESDVKELLRYYNNTKKAMKGIGRRGMGGGAMNRIMGQFMK

SEQ ID NO: 5990 - protein, 188 aa, Methanobrevibacter ruminantium
MLENLVESLRNAPVVKKGDYDYFVHGISDGIPALNPCVLKEISEVLAERIDLDKVDKIVGVEAMGIHIATALSLETGLPLLVIRKREYGLEGEHEILKHTGYATSKLYINDLNEGDNIVLVDDVVSTGGTLSVVINELKAIGVNILDTFVVVEKGEGKKIVEDKTGENIVTLVKLDVVDGKVVADSLI

SEQ ID NO: 5991 - protein, 335 aa, Methanobrevibacter ruminantium
MSIYDMELKKVIRKINSLNVKNVGLQFPEGLKMQAVAIAREIEKNTEANVIISADPCFGACDVSDRKMNGIVDFIVHYGHTPLPLRYSIPTMFIEAKANVNIKQYLEDALEMLEDYSKVAIATTAQHLHLLDEIVDFLEDHGKEVVIGSSRSTRKGQVLGCNFSSIKNLGADVYLFIGSGNFHPLGIYMFTNSPVLAIDPYSGDIREMSGYADRILRIRFARIVKAREVKKWGIIVSSKEGQYRMALAKELKKLLEDEGMEAFILLMDHINPDVLLPYMELEGFVVTACPRIAIDDSQMYKKPVITPKELEIVLNKREWEKYQLDEILFEDRYYQ

SEQ ID NO: 5992 - protein, 188 aa, Methanobrevibacter ruminantium
MKVESGDFVMPGDFLSVSEEFLPGPGAYEDDGSVKSGVPGNVFVDNGEKEISVISKSGGPNLLKVGDIVYGEVKDVRGQRALISVYAKKGTDRQLALPYMAAIHISQVTPGYIDKLTDAFRIGDLIEAKVVKIMGDNLDLNTEDITSGVVKAMCTRCRAFMEPRTESEVYCPVCNRKEKRKVSKNYDY

SEQ ID NO: 5993 - protein, 92 aa, Methanobrevibacter ruminantium
MEIEVIKESKLELEMIIHGENHSLCNVLRKYLMEDDDVEYAVYGIDHPLTGAGKPVMTIKTKRSKRPRNSLLKAATRLKEETAEFKELIEEL

SEQ ID NO: 5994 - protein, 138 aa, Methanobrevibacter ruminantium
MAYKIPSLTVDIFIFNDEKEFILIKRKNDPYKDFWALPGGFVDYGETTEHAAVREAKEETSIDVELIKLFNVYSDPDRDPRRHTVSVFYLAHGDMNDAKADDDAKDIGIFSFDDLDNLDLAFDHRMILNQVKEYFDKE

SEQ ID NO: 5995 - protein, 131 aa, Methanobrevibacter ruminantium
MEFCPKCNGMMMNTTVKVKKEDLEEKVDEENQSNQETEEEKVVFKCMTCGYEKDPSEVDQDQYKVKETVESSDSVIMRGDESGMRSTVREICPKCGHDRASYELLQTRSADEAPTRFFTCEKCHHKWRGYD

SEQ ID NO: 5996 - protein, 244 aa, Methanobrevibacter ruminantium
MFKAELSDSSILKSSFDAISSIVDEVQIQTDSEGFRLDALDRSHITFVHLELKASLFDEFVCDEPEKINIDTDELMKVLKRSKSDDRVLMSLDEGNFILTFEGEATRTFKIRLIDIEYDSPAPPSLNYPTEFEIPFSLLKDSIQDMDIFSDKITLMVDPEYFKAFAQGEFGDANIEYLHGEKIDASAKSIFSLEKIREMLKADKFSDIVNISLGDDMPVTLTLRRVANDGELSFLLAPRIESEE

SEQ ID NO: 5997 - protein, 537 aa, Methanobrevibacter ruminantium
MDGDFFQLLRRVQKEERTKSTLARVDKDFYKQLYSYIRDLERSVAQNPFDTAQSNLLNNAQRIATEICQWRESKISTAANNNIYRSFHLFKKGNPQFDLIDTTPLHLTPEEETLYFALMDALKTHRYNISLDKFGDEKADWGADDYEDEEEDDFEEVASVVKSRVNKGVVSDEEFFNEGGSSNESVTDGFSGESISIEESGADPVVQEPAVETPVEESSGSGFKQEVQESAVETTNTNVGGSDEVLDRLNQIKNSTVVTDEKYEPIEKQINNQAKVVPNVSMSNNLNYESKNYNGQDNEFDSKLKPDYESDVESEPKIESKPKVESAPRIESKPKVESAPKIESEPRLESKPKVGSEPRVESKPKVEPKTIEDRPKRKSSSTLDFDSIFANPDSQFDSIHNFEPDYEADLANIQASSSFAEPSEADLMFSTKPRPKKEPKPKSQVGSKEEFESRPKVEEPSHAPTAKAERPRSQSIKAFAKKEELENTTVVIYKNIDSFMGIDEKIYGPFIANDVVILPNITAQILIDNNKAGLIDI

SEQ ID NO: 5998 - protein, 92 aa, Methanobrevibacter ruminantium
MKMPKEKRTYCPHCKRHTIHEVHTSKKRKASELKWGQRQFRRVTAGYRGYPRPLPGGNKPVKKLDLRYKCKECGKSHIRKSFRVGKPEWVSN

SEQ ID NO: 5999 - protein, 59 aa, Methanobrevibacter ruminantium
MASNGRGNFLRVKCLDCDNEQIIFDRAASDVKCIICGKTIVKSRGGKAKIMAHIDEVLD

SEQ ID NO: 6000 - protein, 260 aa, Methanobrevibacter ruminantium
MVRKSQEWPNEGELIVGTVYKVLNYGAFANLEEYAGKEAFIHISEVSSGWVKNIRDHVRENQKIVARVLRVNPKKGHVDASLKRIREDQRTKKIQQWKIEQKAEKFLELAAKSLDKDLDTAYDEVGYELMDIFGDIYGAFESAAEEGAETLTEEGISQEWADAITEVAVKNIQPPEVHITGYVDIESYAPHGVEIIREALLAAEDENIEVQCVGAPRYRITVTSTDYKLAEGQLKEAANKAIDIVIENGGKGEFLREIDN

SEQ ID NO: 6001 - protein, 56 aa, Methanobrevibacter ruminantium
MKMKMKKCPVCNIYTLKPQCPNCGGELRVIYPPKFSVEDKYGKYRRQLKKEMLNKE

SEQ ID NO: 6002 - protein, 262 aa, Methanobrevibacter ruminantium
MRTTQFKVLEEVKLNNPIFIEALPGVGHVGKLAIDHVIDELEATKFVEIYSPYFPPQVLVGEGGIVEDMKNELYYLKSAGGDERDFIFLVGNCQGLNPEGQYELCGSILDFVESLGAKEFYTLGGLATGQPLEGVEDRVLGAATDEERIEMLKEADIEIRSADGGIVGASGLFLGLGRLRGMKGACLMGKTPGYFIDAEAAEAILAKLAILVKLEVSTDELEERANEIREMINKAQEMEQEMINRAMGQQQAQTQDDLRYIG

SEQ ID NO: 6003 - protein, 395 aa, Methanobrevibacter ruminantium
MLQIAVTGKPNVGKSSFFNSATASQVEMANYPFTTIDANKAVGHVISECPCKELGVTCNPNNSQCIDGTRLIPIELIDVAGLVPGAHEGKGLGNKFLDDLMQAKVFIHVIDASGGTDAEGNPVELGSHDPLEDIEFLEHEIVMWMYGIVSKNWVRLIRKVEAEHLDFSKVIFEQLSGTGILIEDVIEALRTVSPDYGKWEDEDLIEFVRNLLNIAKPSIVIANKADLPGAKENIERMKEKYPRVIATSAESELALVNATRAGLISYISGDNSFEILEKDKLNPNQIKALEYIQTNILDVYGSTGIQEALNTAVFELLNMIVVYPVGDEHKFTDQKGNVLPDAFLVPKGSTPREFAYIIHTDIGDKFMHAVDARKNMRIASDYEIQDRDIIKIVTR

SEQ ID NO: 6004 - protein, 372 aa, Methanobrevibacter ruminantium
MMHPRPSPIAASLYTLRDLNADVIIMHGPHGCCFRTGRLLESDGVRVVTTAMAENDFILGAADKLEETLQEAYDTFNPKLIGIVGTCASMIIGEDLKEPIENLNLDAVVIPVESHGGFGEGDNTEGAIAVLNAAVECGVIPQEEADRQNEMLRLATVVEKTRGMAQGKYIKPNFGDNKEKVAKIVVKAVKEGKNVAFVLNAKKETSYLFADILNCDFSKLFQDTDSNIKSNKDIENLHFIANLDENIGLPRIRQHAVNITKELNETGIDIECITGGLDEYPITPRKAEEYLNELNPDLVIVAGVPHALYVEELDCETIAVTDGPRLVQPLNELGYSHVIAELDAHSKTLGVDEIVDSDFGMMIRSAIEWELE

SEQ ID NO: 6005 - protein, 197 aa, Methanobrevibacter ruminantium
MITIIDYKSGNLRSISNSFKKIGSKAVITSNPEDIANANHLVLPGVGAFGTAMENIEPYKDLIYEHIDDGKPFLGICLGLQVLLSSSDETPGVKGLDIFKGHVEKIPEGRKIPHMGWNQLKQVKPCPILDGVDGKDFYFVHSYYAVLDDESNLSGICDYGVDLTASVSRDNVFATQFHPEKSGVPGLKILKNFVNLE

SEQ ID NO: 6006 - protein, 230 aa, Methanobrevibacter ruminantium
MIYSKEIENMCPVHKGADHGPAPIPEEGRWVKSKEISDISGLTHGIGWCAPQQGCCKLTLNVKDGIIEEALVETLGCSGMTHSAAMAGEILVGKTILEALNTDLVCDAINTAMRELFLQIVYGRTQSAFSEGGLPIGAGLEDLGKGHRSQVGTIYSTKVKGPRYLELTEGYITEIGLDEDDEIIGYKYINMGVMLDLIKDGTDPMEAIEKASGQYGRFEDAVKKIDPRKE

SEQ ID NO: 6007 - protein, 332 aa, Methanobrevibacter ruminantium
MSLFESYERRIDQIVPVLEKYGIKDLEEAKAICNEKGFNPYDIVKSVQPICFENACWAYTLGAAIAIKKDCKKASDAATAIGEALQAFCIPGSVADDRKVGLGHGNLASMLLSDETECFAFLAGHESFAAAEGAIGIANSANKVRKEPLRVILNGLGKDAALIISRINGFTYVQTEFDYFTGEVKVVREKAYSDGERAKVRCYGADDVREGVAIMHLEGVDVSITGNSTNPTRFQHPVAGTYKKECVLQGKKYFSVASGGGTGRTLHPDNMAAGPASYGMTDTLGRMHSDAQFAGSSSVPAHVEMMGLIGMGNNPMVGATVAVAVAVEEALK

SEQ ID NO: 6008 - protein, 468 aa, Methanobrevibacter ruminantium
MYTFLICLFALILSYFVYGKFLERIIGVDETAKTPAYELEDGVDYVPMNKYRALLVHFLNIAGLGPIFGAIQGALFGPSAFLWIVLGTIFAGGVHDFFEGAMSVRNDGLSMPGIISKYLGDRVRKFFAVLIIITCILVASVFASGSADLLSSLTNIDIHIWLVAIFIYFLIATLFPVDKIIGKIYPIFGALFFIMAVLLISALILNPNYSLPEFTTAGLYLTDKAIFPFLFVTIACGAISGFHASQAPIVARCVKNEKDMHMVFYGAMVIEGILALIWATIAMSFFHGQPQLASIYGSSPSIAVKEMSIALIGTVGLVLAIIGVVICPITSGDTSLRSARITIADELGLNQDKLKTRLKISIPLFLVSFGLTFIDFSLVWRYFAWSQLIVAIAVLLAATVYLIDNKKHFIVTFAPAIFCTVVAIAYILQASEGLRLDPFISNVISVIVALALSVYFILKYRKQPNTTT

SEQ ID NO: 6009 - protein, 81 aa, Methanobrevibacter ruminantium
MGIFSFFKKDKDKEKVESHEEVHSIQINAENCQGCGRCVSVCPNNAYELIEGKSSLKENFTCRDCKVCLAACSNDAITFVN

SEQ ID NO: 6010 - protein, 260 aa, Methanobrevibacter ruminantium
MKIFINADTYKEIAQITKEKLIETANELGIEISEDINEADIICSIGGDGTFLESSKLALQKPIIGINCGTLGYLTDVNPEGIKKAMKDIIDGNYYIEERMMLEAEIIKESGEIIKMPPALNEMSISKNIFGVVRFDAIVDGKLINSYTADGILICTPTGSTAYNLSCGGPIVDPTAEIITITPIAPHTIINRSIVLSDKSIVEIKITELREHTSSYALSDGKSSEIETGDILKIKKSDAKTKIIKLNWQSFIDTVRDKIN

SEQ ID NO: 6011 - protein, 456 aa, Methanobrevibacter ruminantium
MDIEGFVRGRLTKGEDEEELKSILAERIREFKDISEEHSLLMAESVIDEVKTTLELNNTEDEFLKDIITVPKANVGMGKMGVGSRGAGDFFVHRKIAQIVKSTNTQSVVDPNAQDDGGVVKVPAPGDDVYITTAVDGIHSRLSEYPFLGGFHVTRATLRDVCVMGADPVAILSDLHLADDGDIGKLFDYTAGICAVSELIDVPLVAGSTLRVGGDMVLGDRLVSCVGSVGVSQHPPTARKGATVGDIILMTEGAGGGTITTTALYNGYFDVVWDTMNISFVKASKALFDADLVKDVHAMTDVTNGGLRGDAHEICETTGVGLEFYHDKIKTTVAPNVLNMLEDLDIDPLGVSTDSLMLVVPPEIADDVVKTVSDVGVYITEIGKVDDEGSPRLIKEDGSVDTLVPLFREAAYTKIKKLVGDTTPEDFEIMKEKVQKAADDSIRKKERVIDYILNNN

SEQ ID NO: 6012 - protein, 137 aa, Methanobrevibacter ruminantium
MALEGAERIDEFISEAKVFFLATVDGDKPKNRPLGFHLLKDGKIYFGVGNFKDVYKQMEANPYVEIVALVETDFLRYYGKAVFEETYDMADAIVAGNEFLQGIYNDETGFKLAIFHLEEATAEIRDITGKINESYNF

SEQ ID NO: 6013 - protein, 131 aa, Methanobrevibacter ruminantium
MSLFKNFIGNFKKSDVLDLAKGFKLEYEANNLENMKSIVDKFVDFHPDSYFASCSMVIYIIQLYKKDPLKVSPNMLNNLSIMERNIKFYDNSSTDSLDNEELELRQWFKKEVYENVKYMESAGLRFSADDK

SEQ ID NO: 6014 - protein, 52 aa, Methanobrevibacter ruminantium
MQLNKICLAAIVLFVLFTILKFVMKWSFKLFAIGIVICIILAIFGFFKGDDL

SEQ ID NO: 6015 - protein, 212 aa, Methanobrevibacter ruminantium
MSSNSDKDILKELRDITKDKESWKSNINHVAVKLNDDFSLSVKAKVLWLLGEMGLKHPLEIEEYVDDIAVYLEDDHPKLRERSANAIGRIGRADKNLVINYMDKLMKLSDDESESVRHAFIWACENIAVNAPELFCEKLDIFYEMISDPGEKVRIEAPEIFRVVGKRNPSCVKPYLDKLEHIAENDENPVVRIHSAGAVRITRKALKESDNA

SEQ ID NO: 6016 - protein, 230 aa, Methanobrevibacter ruminantium
MGFFSNMRKPEGKLGNIQLKSMNKEHTPVSLWGLKHLDISPEDTILDIGCGGGMNINRMAQTAKKVYGVDYSIESVNLSKEVNADFIRSGKVEVYEGNVSNLPFEDNSFDIVTAFETVYFWPDIEKSFGEVKRVLKPDGMFLIGCESNGANNLAMKFFDRVIDMELYEDNELYGFLKNNDYGDITIYLRDGKNKQEIIKKDDKTFVIDDDYDNFSISDRWVQWMTITAIK

SEQ ID NO: 6017 - protein, 452 aa, Methanobrevibacter ruminantium
MLNANTYVTEEEGIGGTIRNRWEDFYVEEIPEVIPDGEGPNIYIWIEKLGRTTLDVLLDIARDLHIDRKRMGFAGMKDKKAITRQWICIANMDSEEQFAQVEALAGTIHNTEFLKVIRGRKKLRMGQLKGNKFRILVKDIDGMESDNEETRKLAIEDAAKRADAILKTLEKTGVPNYFGWQRFGKPRTNTHLVGEALIHNDLKEAVRRYIGNPSEEESEDSRKARQAFDDGNWEESLELMHPGMRYEKMMLKVLLKEKRRAIRKIAEEEGIEIEEVDESKVELSDKAYKNAIHALPKPLQRMFVHAYQSFLFNAAVSERVAMGMDKYIEGDIVIDKEERIVRDKTPEEFQEMVSSFEINQTCPLYGTKVPFAGGEVGKMEEEILNSYGLTRDDFEVPKMPRLGSHGLRRSMRFQVWDASATATEDGVMCEFSIDKGSYATAVLREVMKKDVY

SEQ ID NO: 6018 - protein, 224 aa, Methanobrevibacter ruminantium
MDWSPIFISMKTASLSIFITFFLGLIVAWLLVKIKNDTTKIVLDGIFTLPIVLPPTVVGFFLLYIFGIRGPIGSFFLDFFAVKIAFSWPATVIAAVVMSFPLMYRSARGAFKQVDSNLLDAGRTLGMSEWKIFWKILFANALPGIISGGILAYARGLGEFGATAMLAGNIAGQTRTLPMAVYSEVAAGNMGTAFDYVIFIVAISFIAIFIMDYFSIRKENQWKN

SEQ ID NO: 6019 - protein, 129 aa, Methanobrevibacter ruminantium
MIECRNISKGKAEGELIVSDEAISFLGGVDPETGVVIDPNHELKGQSIKDKILFIPGGKGSTVGSYVIFQMMKNNTAPKAIICLKAEPIIATGAIMSDIPMVDSPSSVEELVNGQMVEVDSDNGKIEIL

SEQ ID NO: 6020 - protein, 412 aa, Methanobrevibacter ruminantium
MPSLYIKNVNIINPFSEEPLDERHVLIKDGRIESLHAEESALYANHIVLDGEDNYLLPGFIDSHAHVMANGFHKEDTMKNPLALHFYNAIENMKATIDAGVTTVRDTGLADIGVKMAQERKIFPAPRLNISIKPLAITGGHFDFYLNSGFDMELAYPGFPIGTCDGVEDVLKKTREVIRARADFIKIMASGGILSPNTSPEFAQFNKKELKTIVSEAENYNLKVAAHCHSLEGIQRCVKAGIKSIEHGTFIDRKTSELLAKKRIYLTPTLIVHQTLIKEGFPVWDNFADDKVKKLKEVVKIQKENIETAYQCGVKFLMGSDCGVIDHGRNLGELKQLVDIGLSPLEAIQAGTIEGAKFFNQENDLGSIETGKIGDVILVKENPIENIGSLVDNDNILAVIQDGKILKDKPIY

SEQ ID NO: 6021 - protein, 82 aa, Methanobrevibacter ruminantium
MNEADFIQEIMKQANLSEDQGGQVNDIFQSTFLAGNKNKDTIVNLIAEKLGVDAAQAEQIYDIAIGLLASGVLSKIKGLFKK

SEQ ID NO: 6022 - protein, 68 aa, Methanobrevibacter ruminantium
MAEKELNVVGMHCPSCVMAVELSMKDLNGVDDAKASLDTNSVTVEYDPDKITDADLVGAVKEAGFDVE

SEQ ID NO: 6023 - protein, 492 aa, Methanobrevibacter ruminantium
MRIKYLSKQDIKIILHYLGYIMIGIGAILLFPLPIDLFYREFNYVYGVIPPLISIILGVIFSQGFREYDKLKFKHGMIISSISWLWAGLVGAIIMMLILDVSFVDAFFENISAWTGSGLTMFSDVESLPMSILFLRSVEQWIGGLGVVIIFISLLIKPGTSAFKLYKSEAREDRIKPNIKNTLKKTMQIYAIYTVIGVILYLIAGLPLFDSINLTFTTISAGGMSIKNANIGFYQNDIVYIITIFLMILGATSFTVHYKMAKTKGKAILKDIQFQLLIVSIILSAIAIAIITKLAPMDVVFHVVSAITTTGANIAPPSEMAAWAPPALIIIIVLMLMGGSSGSTVGAIKLVRVITLLKSTHLAVTNIVSPGRFVKIKISGKSINEGEMKEASSYMAVYIFFLAISWIIMTYYTNDPFNTLFDVVSTLGNVGLSTGIISGELGTIPKVVLIFLMWLGRLEIIPILLTIQIGFETFNQSLRFVKRRMMRKIKPN

SEQ ID NO: 6024 - protein, 551 aa, Methanobrevibacter ruminantium
MFYPKIEEVKEIAKDDSYKRIPISYEIFSDTKTSIEVLRRLRILSNHCYMLESVEDSKNWGRYSFLGFNPILELTCQDGELVIKGKSSFSDCGIEDEKDKCFSIKTDNPGEYIREIIEENKSPKLENIPPFSGGLVGYFSYDYIKYSEPSLILDAQNQDAFKDVDLMLFDKVIAFDNYKQKIVVIVNMKVNDEDMLKNESIEENYQKACNDIKDIVNIIKADNIVDLLNDDFKDQLTNKKTIKSLEEMKGLKTLEELDRCRKEITKHLPIELKSDFRYLFSKEEYCDMVERAKHYIREGDIFQVVLSNRIEADIEGSLFDVYRVLRTTNPSPYMFYFSSDDIEIAGASPETLVKLVNNQVYTFPLAGTRPRGKTDEEDRQLEEELLADEKERAEHNMLVDLGRNDIGKISQIGSVKVNRYMDIVRFSHVMHIGSTVEGILRENYDYLSTIDSILPAGTLSGAPKIRACEIINELEDNKRGIYGGAIGYIDLTGNLDTCIAIRIAFARDNKVFIRSGAGIVADSVPESEFVESINKAQAVMDALRLADGGIE

SEQ ID NO: 6025 - protein, 208 aa, Methanobrevibacter ruminantium
MILLVDNYDSFVYNLYQFIGEALANIKGYDLASKGDLYKIYEEIKVIRNDEMTVEELRELNPDYIILSPGPGKPKDAGICKDIVKEYINSDVPILGVCLGHQAICEALGTNIIHAKELMHGKTSIIELDEDKIFKDISDPIQIARYHSLAVENDSLSNDLIVLARTDDNEIMAVRHKNANIYGLQFHPESVLTPEGLKIIENFLNIKN

SEQ ID NO: 6026 - protein, 335 aa, Methanobrevibacter ruminantium
MIKEAILKVYKDEDLTYDEAYATMDEIMSGEASEVQMSAYLTAMSMKGETIEEITASAEAMRAHCVRLLNDEEVLEIVGTGGDGSNTFNISTTSSIVISAAGVPVAKHGNRSASSKCGAADVLEELGVNIHISPEKSLACLKEINLCFLFAQNYHLSMKYVAGVRKELSIRTIFNILGPLTSPAGASMEVLGVYERELIEPLTDVLKNLGVKSAMVVYGLDGMDEISASDKTAVCELKDGKTRTYEISPEDFSMDIASKEDLVGGDANENAEITLAVLNGEKGPRRNAVLLNSAAGLYVAGKVDSIEDGVKLAEEIIDSGKALNQLEKFIEVTNR

SEQ ID NO: 6027 - protein, 258 aa, Methanobrevibacter ruminantium
MLKKIVAKTEERLIEAKKIKSLDKLKEEVSKLEINNEFPFKEALKDPEIAIIAEVKKASPSKGLIAEDFDYIKIAKEYEQAGASAISVLTEPYFFQGSNDFLKEISQNVSIPLLRKDFTIDEYMIYEAKILGASAILLIVSILDNVQLKNYLDLAHDLGLSAIVETHDADEIRTAVDAGAGIIGVNNRNLADFTVDIENSIRLRSLVSDKILFISESGIKTAEDVGRLKKNNVDAVLIGETLMRSDDKKSMILELKNG

SEQ ID NO: 6028 - protein, 217 aa, Methanobrevibacter ruminantium
MLKLKICGLRRKEDIDIVNKYNIDYIGFVFAGSPRKVSYEQAKELSALLREDIIPVGVFVNEHMKLIVDLYKEGIIKIAQLHGDEDEDYIKNLKAKSLEQTGHEIPVINAIEINNANNYDNFNDKLLEWRDSVSDYFILDSGKGSGKTFDWSLLDKNSEFFKNSIFLAGGLNSENLDSAIKEFNPYAVDLSSSVETDGFKDEEKIKEIVEIVERYRN

SEQ ID NO: 6029 - protein, 394 aa, Methanobrevibacter ruminantium
MSRGRFGVHGGQYMSETLMNELLNLEKQYNHFKEDPEFIEELNTLLKEYAGRPSLLYYAKRMTEDLGGAKIYLKREDLNHTGAHKINNVLGQCLLAKKMGKTRVIAETGAGQHGVATATAAALLDMECEVFMGEEDTKRQALNVFRMELLGAKVHTVTTGSKVLKDAVNDAFREWISRVDDTHYVIGSTMGPHPFPTIVRDFQAVISQEMKEQILELEGKLPNMVIACVGGGSNAMGSFYNFLDDEEVELVGVEAAGKGIDTEYHAATIAKGELGIFHGMKSYFCQGNYGQIAPVYSISAGLDYPGIGPEHAYLHDIGRAKYVSATDDEAVEAFEYLSRTEGIIPAIESSHAIAHAMRVAGDMDKDDIIIINVSGRGDKDVAAIARYKGVELYE

SEQ ID NO: 6030 - protein, 260 aa, Methanobrevibacter ruminantium
MEKDIKISDAFKDGKAFIGFLTAGDPTIEKTVEYVLAMEEAGCDLVEIGIPFSDPVAEGPVIQEANIRALSNNTNTDDVFEAIRQIREKSDVPLVFLTYINPVFYYGYDKFFKRCQELNVCGIISPDLPYDEKDEILEVTKKYGVDIISLIAPTSKERIQMIASEASGFIYVVSSLGVTGMRSEIRTDLKSIISDIKEVTDVPTAVGFGINTPEQAKNISKVADGVIVGSAIVNIIAEHGENAREPLANYVKSMKDAISK

SEQ ID NO: 6031 - protein, 462 aa, Methanobrevibacter ruminantium
MQGKTLDTRTRNLILILFLIGVFMGSLDTGIIGPVLPSIEQSFHLTSRESSWIFTLFVITFMIGSPVMAKFSDFYGRKKIFILDVLLFGIGSCLIAASISIELIFLGRLIQGFGCGGIFPVAGAFVGDGFPLEERGKALGILGSVFGISAIGGPLVGAALIPYGWNWCFTINIPIAIFLIIFAWYILPDSDNDRKLKIDYLGILILSLLAIFLSYGLNQIDSSNFIASLLSLNVLPFLVIFIILIPIFLKVEKKAEESIVPIHMLKNKEISIACIETLCYGIIYSSAIFIPSLVILSMGLDDQLASLMLIPILGANAVAAPILGKILDKTGSKKLMAMGTMILAIGLIAIAIYPSNLIFFIIAGCLIGVGLVTIIGAPLRYIVLTEAKPYERGAGQAIVNMLSSAGQLIGGALIGGIIASFTGILGYQVSLIIAAIVALIAFAFTLRLKGRDEQIATMKANQ

SEQ ID NO: 6032 - protein, 137 aa, Methanobrevibacter ruminantium
MPFIALIHHISQNKLRYARKNPNHIDMVHEGRYLMEIHKRKNLSQDDLANIFGQSKGTIAKALRKLEDKGYVERIINQNNRRKYILKTTQEGEKLAILLEEDLSSWEEAVGIDKLDDETKNQLRKIARKTEEILKEE

SEQ ID NO: 6033 - protein, 227 aa, Methanobrevibacter ruminantiumMethanobrevibacter ruminantium
MIGNDWDNALEDEFNKDYFIKIKEFVEAEYKTKTIYPPKEEVFNAFKLCPLDNVKVVILGQDPYHEKGQAHGLAFSTPEGHPIPRSLKNIFKEIKEEYNYPIPDSGCLESWAKQGVFLLNTVLTVEEGNANSHSKCGWQTFTDNVIKILNQQDSPIVFLLWGKQAELKKELITNPNHLVLISSHPSPFSARRGFFGCNHFKLANEFLKDKGLEEIDWQIKNVQTTLI

SEQ ID NO: 6034 - protein, 243 aa, Methanobrevibacter ruminantium
MKYLIINGSPRKKNTWAMVKQAKTNLEGEFEEIQLMKTKIPMCNGCFKCIMEGEDKCPHFETVHPIVEKIKEADGLIITSPVYAMNVTGLIKNFFDHTAYIYHRPEFFDKKALIIVSTAGAGHKNVAKYMDETLRHWGFNKNHKITYACGGKDTINTEEINKTAQKFQKDVSSKKLHSPKFMDIVFYNVWRAMAVSKDPIKADKEYWEATGLVNYDFAPNVKLGFFKGIFAKIVFAMMKKVIK

SEQ ID NO: 6035 - protein, 447 aa, Methanobrevibacter ruminantium
MAKKNTKEKIFDSSIDLFSQYGYTNTSIRQIAKEVGIKESSIYNHYQSKEAILESILNYYISEMLKEEAPIMQSNDNLDLGFEYFYKQGSDRFLSKLSEERMMKITRIFLVGSYHNEKMKAFVKEGIIDYAIKGWEELFNLMKEKEIIRKDANSKQLAESFYSYGIFLLYEHFIFNYPEDDEKFLKDFERRTTDHMKIIFNSVKINNEESKIDNNKNNPSSNHDKENKELETEIMRLEEEKDYKKVENLVRDAFWNIYRPGAYEHFIVYNLREDPSFIKDLAYIIEEDDEIIGHINYSKGNLNLYKKNNQGMEKINDWNEEAVVLGPIAINPKYQNQGYGFRLIKHTLRLAKNKNIPYVFVIGDENYYNRFGFESASKYNLFLEGTDTSEENPFFMIRIFKDLFKDKDYDRGIFYNPKVFNVSQDDVDKFDENFEYKQKRVQEGQLE

SEQ ID NO: 6036 - protein, 342 aa, Methanobrevibacter ruminantium
MFDAKFQYTNKIINNLMEISTIKEFILNSQILPSYDILLRNKAIITSSYNSTSIEGNPLDFKQVTKLFNLKQENKLDELKLNKSEIEVLNYFKTLENLDNYEKIDEETILDIHKNITEGTLKDPNMAGKFRDSPVVIGNIKTGQLNYVPPSPIKVPYLIRELLDWADVQEDLNPIILAGIFHYEFVRIHPFVDGNGRNARALATLILLLKDFDIKRYFSLDEYYNQDRQSYYNALQSADKSQDLTEWLEYFSTGFLVSLSNVKKDIESISRFDIKMNGKIKLNEKEIKILEFIEKNNSIKNKEVQDLLNLSAQRSHFYINELVKKGLIKSKGKGRSTVYIFK

SEQ ID NO: 6037 - protein, 249 aa, Methanobrevibacter ruminantium
MIIDTHCHIYNSEMENAKEIIKEAQKNDICLILNGTDPKSNKEILELSSKYDNVYGALGYFYTLADEISDEEIDLLDSQLNNDKIIAVGEIGLDYYHTKENKDSQKELFEKMLDLAEKHKLPVIVHSRKASQDTYDILKNHNAVGSLHSYQGSAEMAREFVKLGFYIGIGGTITYKNSKKIRKAVNQVGISHILIETDSPYLPPEDKRGENNTPLNLKYIIEELAEELDIKEEKIIEITTENAKKLFKV

SEQ ID NO: 6038 - protein, 238 aa, Methanobrevibacter ruminantium
MDEKFSRTEMLVGNEGMEKLRNAKVVIFGLGGVGSFVCEGLARSGVGNFVLVDYDKVDETNINRQVIATTKTIGQCKVDIMKERILDINPDANVEIYKEFYLEDCEIDIITSDLSYAVDCVDTIMAKIAIICKSKELGVPVISSMGTGNKLDPTMFEVADIYETSVCPLARIMKKDLRKRNIKDCKVVYSQELPKNTNDCDINKNKGKVKVKGSISFVPSVAGLIIAGEVIKDIVNAK

SEQ ID NO: 6039 - protein, 156 aa, Methanobrevibacter ruminantium
MFRKMRRAKQELSKEECIDILINEPRGVLAVLGDDEYPYAVPLSHVYVDGKIYFHGTIKDSHKRDAIKKHDKVSFCVMDKGTKSDSWWYTFKSVIVFGRMKTINDKQTKIEKLTYLGNKFFPSEEETKDEIDRLLDVTELYEISIEHMSGKVVKEK

SEQ ID NO: 6040 - protein, 449 aa, Methanobrevibacter ruminantium
MAIHPIEFRYGTPEMKRIWEQENKQQRMLDIESALAQAEGELGIIPKEYADEIKAKASIEYVTLERVSEIEAETKHDIASLSKGLSEVCEGEAGEYVHFGATSNDIVDSSNSLLLKDSIEVLEEKIERLTKIILKLADENKTKVCIGRTHGQHALPTTYGMKFAIWADELHRQYDRLQHAKDNVCLGMMDGAVGTTAALGTQGWEVHKKVSEILGLKPAPITNQVLQRDNHVEFIATLANIATTLSKIALEVRNLQRTEIQELGEYFDPEKQVGSSTMPHKMNPITAERICGVARIVKSYVNAAMENNPLWHERDLTNSSCERIMFPEACILTDYILNLTIKLMNNLIFYDENIERNLNFTNGLIMAERLMAELTRAGMGKQTAYGVARKNAIKANKEKLLLADLILEDPDASQFLSKEDVERIMDPHTYIGSAPIIVDEILEASKDWF

SEQ ID NO: 6041 - protein, 268 aa, Methanobrevibacter ruminantium
MDFSVKDFNVRLRTIRIWEVVIALVVAFFLTGFTCDYFGIYSGEAEYIIFFLYMMVFFAIASIGTHGFKDDIYGVFKASNLFKVIMIVIPNMLLAFFIQQHLAGFDAMFNNINLLALPVSDLAYEASNPLLFLFEFFSAIFIAPISEELFFRGILFNRLKIRKGVIFGVVVSSIIFGLCHFNYPDHLAHIIYTCLFGMCLCILYLRTDNLLINMFAHFLYNLLSYVIVYTPIGDLFLGGPFMDFTVIVLLFSIVFVPAYIFYFSIKLK

SEQ ID NO: 6042 - protein, 80 aa, Methanobrevibacter ruminantium
MKTIIRYLRQEVKMSQQDLAKSAGVTRQTINALENGRYNPSLLLAYNITRILNKATYGDDVDSYLSIEDVFKFDDDEISV

SEQ ID NO: 6043 - protein, 209 aa, Methanobrevibacter ruminantium
MFLIYGYSYRVTKVSVEGMINGNDPLPEFDDVIGMFVDGIKVCLVYLGYALVPIIIFMVFALVSSAIGGYGESVLMAFGSIITLLAIIGAYVMSMFGVANMANYDGALAKAFDIKEIIEIIQSVGVVRSVGAYIGLAIICTAIFMIVGLLLFFVFGFFGIITGTLGSYTAAGGIFIAGIILGYFLMLFIVSPYILIMQSRVAGLLYNLH

SEQ ID NO: 6044 - protein, 127 aa, Methanobrevibacter ruminantium
MSNNYLPKKLEIKYSHQIDGTKSIKLLNGTLLVNNPNPELIDINQIDEEKWIEFWDAVEKIGLWDLEEVYESCTLDGGFTWKIEIEYGNREINSYGANMEPKIIMGDKVYSVLEELYKSIEELISLD

SEQ ID NO: 6045 - protein, 258 aa, Methanobrevibacter ruminantium
MIFDFHLGSLFFKFILYLVMLLFFIYKFNSISKKNSSSNFNYNSSSNRDSNSVNNSSLSDAFRNDLNSIFKVSKIYHILFIVLANILFVSAIYFVLSYLGSISIIQFNAPLFGDFTGLGFDVTLLYLITVVILSPIIEEFLFRGIFLRRFNLELDNLTLAILISSVLFGICHNFGGILGAILFGICVSILYVKSRNVLVPILAHFINNLISFLLALIGIENFIHGNSIVIALIIILAIISNFVLFRAIVLEWPKSFKE

SEQ ID NO: 6046 - protein, 1187 aa, Methanobrevibacter ruminantium
MDSGMDYFERLESETQRLYEIANEARSKGFDVELETEIPVAKDLAERVEGLVGPKGIARRIKELEATGISREEVAFEIAAEIASQESSETGAKLEAEKQAFADQGLRTALAIITEGVVAAPLEGISGVKIKSNSDGTKYVAVYFAGPIRSAGGTAAALSVLLGDKIRVATGLDRFKPTDDEIERYVEEVELYESEVTNLQYSPTPEEVRFAARSIPVEVSGEPTDQIEVSHRDLPRVETNNIRGGALLAMVEGVIQKSKKILKISKKLNLDSWEFLAEYAKGIGSSQEEEKSEEETEEIVEEIDDNIIDKDELFAHSKYAHDIIGGRPVLGYPSEKGGFRLRYGRSRNTGLATMGVHPATMELLEFLAVGTQLKIERPGKGNCVVPVDSIEGPTVKLKSGEVRRLDSIADAREVKGKVVEILFLGDMLVAFGEFLRNNQPMLGSCWCEEWWIECIRNSDKYKSFSNDSELYDYLIERGIDLSIEHFISHEDSSKYMDFDRESFNLNFLEKKRYTAEEAFRISYDFSVPLHPEYTYYYNDISREDLAYLNEWLDTKRDYLSTDYLNGEDLILDLAPQKRILEILGLVHKLIDKKVVIDRDHAYALMKTVGNGSALEDNDGDLSSEVKTIDYSKYLDDDHYKSKVVDILNENIDFEIMDKAPCYIGTRVGRPEKSKERMMRPAPHVLFPIGNNGGSRRLVAEAAKKRKINVEIARRQCTNPDCGLSSFMAICPHCGAPTEITKASQKDINLSTMLSKASNNIGVRKVDEVKGVIGLISEDKLPEPLEKGILRAKNGVFTFKEGTIRHDSTDLPLTHFIPREIGVTVPKLIEMGYTHDCYGQEIVSDDQIIELKVQDIVVSDNCGDYLVGVANFVDDLLEKYYGMDRFYNVEDKYDLIGHLIAGLAPHTSAGVLGRIVGFTKALGCYAHPYFHSAKRRNCDSDEDSVLLLLDALINFSKSYLPSTRGGSMDAPLVLSTRIDPEEIDDESHNLDIFERFPLGFYQKSQEPLKPADMLEFVDNVEMHLGTDRQYHDLMFSHHTSNIHAGPKVCLYKRLGSMKEKVEAQIHLAELIRAVDQRGVVEGVLSSHFLPDIMGNSRAFSKQKVRCPKCGAKYRRMPLTGKCKCGGDLILSVSKGSVVKYLEISQNLVNRYPVSHYLEQRLEIQEFGINSLFESDKSKQSSLDVFFGK

SEQ ID NO: 6047 - protein, 780 aa, Methanobrevibacter ruminantium
MGLKINEGVKVENVYNVENDIRKAKITVKKNNGVCEAFSYEKLLKSLVMVEAPYFESEKIVSTVVENLYDGITTKEIKKIVYECLEEVDSEAANKYLAKTTLKVRSSRDKIEPFDMAKIASTLVEETGASQETAFEIASEVWKELKKLNVEYLTAPMIREIVNTKLVEYGLEDLRSRYTRLGIPVYNITSLIENGNRDNANMMHNPESIHKYVADEALKQYALLHLLPSHLADAHMSGDIHIHDLEFFAGRPLNCLQHDIRAFIKYGLKVDGTGDHTSVAAPPSHMETLMNHTGEIMLAAQQNMSGGQAMSLWNVFVAPFARGRTYEEVKQSIQMLVYNLNMAYAARGSQVPFTSMQLEFGVPNFLKDVTAYGPKGQVVGTYADFEDETRMIQRAFTEILLEGDSEGKPHLFPNTIYTLREETLNGDYDDDMLLVHELSAKYGSSYFVNMLPDYRGQMANYMGCRTCLQDTWTGDWEQDCLRTGNLAYVTLNMPRIGYQSNDEDDVFEYLDNYMDLAVETLMIRRKQGLNCLNNFDILPFLDQEVDGETYYRIQNSTLSFGFCGLNEMLLALFDEGIENPDANKFGIKCLEYINARAKALQEETGLRWSVLQTPAESTAYRFATLDKEQFGDKAILQGDNGANYYTNSSHVPVNSDIAFADKIKIEGQYHKLTPGGHIFHAFMGESYSDPEALMSLTNKIARKSDIGFWAYSSAFSFCLNCKTLMKGLSNKCPSCGESADVEWYDRITGYVQQVGHAKSANGGWNAGKRQELIDRRRFEQ

SEQ ID NO: 6048 - protein, 528 aa, Methanobrevibacter ruminantium
MKHWIERIADELNEMDVEKHVIASGTSISGSIHIGNSCDVFIANAIGKALRELGNDAETIWIADDHDPLRKVPYPLPESYDQYLGMPYSMIPCPEGCCKNFVEHFEKPLFNVLDDYGIEIIPKSGFEMYKDGSYLESIRISLEKHNEIKAIFDQYRREPLADHWLPYNPICDECGRVNTTEAYDYDGDIIKYRCECGHEGEMDIKSGNGKLTWRVEWAARWKIFGTTCEPFGKDHAAAGGSYDVSSVISEEIFDYPAPYPVPYEWITLDGEAMSKSHGVFFTPEQWLEIGPAESLNYYLFRSKPMKSKDFSPKMPWLDFMDTFDRVEKVFYGEEEAPSEKEGRKFKSIYKMAQINPDSPLPFRPPFRFLVNAYQIVGEKDLEKIFAIVKKNSQLTKSFADKEFEDLSELEVSQFSERVDNVIAWLEKYAPKFVKFQVQYDSIPNLPLPDDQIAFLKDLADLMEEKEFSSAEELHDSMYEILESHGLKPQKAFQAIYKMILGQKQGPRAASFLLSLDKDFVVKRLRQEA

SEQ ID NO: 6049 - protein, 286 aa, Methanobrevibacter ruminantium
MVIFISEEEIETLKKQLADKDTKLKNQASELNHLTNEVIPELKKDNKKLKALKEELTDALETSTKKYFDQLEINADLSESVAKKGAGLQLAKVRLNEIEKLVVELETARLEEEEKKAAIPTEETDEDEVTKIYQEKEEAIEQLHSEIDKLENEIKEKDAEIDRKESLIKSKDSKIKEKNDEIKDLNDNVIPSLKAEVASKNAEVKATQEEAQKEIDGVGGKIAKLEAEIKNLNESLDKKKRDYDRLYTELNAKDKTINSLKNKNQQLTEQLEEESSKGFFSKLTGR

SEQ ID NO: 6050 - protein, 79 aa, Methanobrevibacter ruminantium
MSFGMVFFSCLGICLFCNEFWYGFFLVVWGFVCFVMSFGMVFFSCLGICLFCNEFWYGFFLVVWGFVCFVMSFGMVLVN

SEQ ID NO: 6051 - protein, 305 aa, Methanobrevibacter ruminantium
MTIKKDLLAIGHTALDYIITVDEFPKANNSAPMKTMLNLNGGAAANVAMIGASLGLKSGLVSAVGKEFIDSHYHKEMTRLGVDTEAMIISETENTPTAFVMTNKNQDQISYFYWGAGKDFHDSEVPREKIKEFKAVHLATGDPHFNCKSGIVAKEEERLVSFDPGQDLGMYSPKKLKEVISNSNILFGNHHEIKRIQESLAVDINGLMELGPEIVLTTCGKEGSIIYSLDEGKFEIDSIYRPAVDPTGAGDSYKAGFLSQFINGKTLEESAKFASSVSSFVVEKQGCQTNMPSYEDAYNRMMDFY

SEQ ID NO: 6052 - protein, 432 aa, Methanobrevibacter ruminantium
MTQISDAKKGILTEEMKHVAKIENVSEDFILRSVANGTIVIPSNVHRDIEASGIGAGLRTKVNATVGTSTDIVNFDEEVLKAQIAIDHGADCLMELSIGGDLDVIRRRVLDMSPLPVGSVPVYQAAIESIREHGSVIYMDEDDLFGAIEKQAKDGIDFMAVHSSINIETLTRLKRQGRVTGLVSRGGSFMSGWIVENEKENPLYANFDYVLEIAKEHDVVLSLANGMRAGSIADSTDRAQIQELIILGELIDRSREAGVQCMIEGPGHIPINEIPTNVMIQKKMCSNAPFYMLGPIVCDVAPGYDHIVSAIGAASSAKAGADFICYVTPAEHLALPSPEDVKEGVIATRIGAYAGDLASGQIDGSQDLAMAEARKKLDWEAQYECAMFPGAARAKRDQRPPEEEDTCTMCGNYCAVKIVNQWLDQSDSDLIK

SEQ ID NO: 6053 - protein, 309 aa, Methanobrevibacter ruminantium
MRDIMLENTDNEKGKAIIEPEIGITINGISFNHKLFETLESLSRTYSQRKTAKELKIAHSVLNRRIKNAEDKLGEKLVVTIGSGSELSPKGYELLNAYHKYKNRLEDREEIVIAGGHIITGLLQAISYDLPFKTLIYSSDDESAYELAKSNQIDILALDDPLLAFENDLNFTAIAYDHLVLISPKKEKPIEKIRDLSDLEFIGVKGSAQRLAWSTLKQENIPFNIVKEVKSQFDAFKIVKNSDEYYTFLNASYFNGNEILKNETRHVISLVQCNDEKEDIYNLMEYLLMDGQSQIGEQGFVPMKPWKTR

SEQ ID NO: 6054 - protein, 196 aa, Methanobrevibacter ruminantium
MEYMKDAIEAILDNIRDAEDYLVEEDVATFIDIITSCENIFVTGAGRSGLAAKAFAMRLMHLGLSSYVVGETISPAINADDCILAISGSGETNTIVTAAKISKNRGAKVLALTSYPESTLGQLADCVILVKGRTKVEADDENYLKRQIKGNYTSLTPLGTAFELTSLVFLDGMVSELMNAMGKTEADLKLRHTVLE

SEQ ID NO: 6055 - protein, 276 aa, Methanobrevibacter ruminantium
MTKLVEVKDVSFSYDKDSPIVFENINFSIEKGDVLCILGPNGTGKTTLIKTLNGLHKVNSGEILLNGTNIKELSFNDIAKLVGYIPQGHIPSFPFKVFDVVLMGRSPYINLTASPREEDKEIALNALKTLGIEDLKDKSYTNLSGGERQLVFLARVLAQEPDLLILDEPTNHLDFGNQIKLLEMIEQLSELGLAVIMSSHYPDHAFLAASKVAIMKDKSFIDFGTPEDVLTEENLNKAYGIDVKLVELEDDRKICVPLRTNLELVMSNYSKKYSKD

SEQ ID NO: 6056 - protein, 190 aa, Methanobrevibacter ruminantium
MVSVEDYEEQLAKAGEFHGEICGGIAIGTKLAMYGMELMGFELNKRHKNLIVFLEIDRCMSDAVQSVTKCSMGKRSLKQMYYGKFAVTFYNMDTGEAIRVSDADANKQEKKRETRDEMIERFKRTPAEELFNVEKVHVELQPSQMPGKPHTSVFCSVCGEKVTDGRHVNRGGKPVCIPCAEGAYYELIDE

SEQ ID NO: 6057 - protein, 446 aa, Methanobrevibacter ruminantium
MGGIYIIMKTFRQQLLEDPEFQNYLLQRPNLTESSLQSYLNAATNFVRFTGEPFYKTVHELRSQQNDRIENNIIIRFNPNQSRINIMQFEFIEYLKGRGCTEVSIDSYVRYMRTILSTLGIILPKSPKLDDTPQDWYLLTKDDIKYVLDTANLQYKAVINFAAVTGLRVRDMRSLTIKDFMTATEEYHGCTEVEDFLDSAPDGMIGFWELFPQKTRKFRLPCKVCNTPESSDLLLFSLNERVKYFEWKNEKDGTDLKITKNDPLFASRQRKYKNFIAPNSISWTLSQYSEKLSAERERVFKYKLEHGEISQETYDESVATIPKFHAHGLRKFFISTLAKNRVDARISALMEGHKAPLVTDSHYINNDYLKETIKEEYMRCIPDLSFENVEVRFLTSEERKSLQQKIDELQEENENMKKDMEKYIDDAVHEKMKDAFENWLNIQDSK

SEQ ID NO: 6058 - protein, 294 aa, Methanobrevibacter ruminantium
MGMKKVKIESKAKNNMTRNEKLFYKLYDDLYNEDRLILFSTYFNIYDKFIFKKDIIHYVLMNYSENEIIEAMKKIDEIQSEGIDIKTFIPKKYCPKCKKVMDSYGKICPDCGTILIEDEKKIQELQAKDKAYEEYLEKEYNIYLQNSYHNMIQGSYTIKIRTRKPKTETEIVRIPAQTVTSRGKFNSISQHYPSETYTRQKVTRAKYKECRVLFDKEKMILNIDGTATKLYYDEVCELEYPEQEVNELVTLTLHNGTVLTFKIKNGWFASDNEKKARFDAFVKTFIEQGKNLPL

SEQ ID NO: 6059 - protein, 72 aa, Methanobrevibacter ruminantium
MQYWRIVNYSPLAVACKKRKHWTCNHSFYATFYILNFQIFKILLFMAKQQLLSRIDLNLLFLIYFQNFLLII

SEQ ID NO: 6060 - protein, 74 aa, Methanobrevibacter ruminantium
MVAEMVENIRKGEGDGYSIYPPFSCIVFLQGKKYSECCCKAEARDQKFALVNLVGFRREDVKVIDPRTNEELFV

SEQ ID NO: 6061 - protein, 144 aa, Methanobrevibacter ruminantium
MMANKIRVNLTVDPNLWQLAKDKLPCSRSEFFENQLKMFLGIEDDESEIIKDIQTKENEINALRDKLCHVRKSKQLKLESNKSMEKAMASLNRMHKKYGKIGENQIRNLAHVHKVDFDDLKKECQDNCMNIFEFAEVPKHDSVM

SEQ ID NO: 6062 - protein, 139 aa, Methanobrevibacter ruminantium
MELFLMTIGSLDNFGKSDGENMNPEDFDCSVFFEMYKALFEILDVEVGSFAELLDVYKNVEMDYTLKRHALKQKEILYWFNTDWKEELGKEKPTEKDKEKWIRQKIGYDSFVVEQLEVKLKHIRRMYETALKHSFEAIK

SEQ ID NO: 6063 - protein, 91 aa, Methanobrevibacter ruminantium
MNVKTVMNDLIGLSKEFEGVEYEIESKNSIYFYSFPKYMKEGIVILKYSAIYDLHTILKGMDGIIVDILEVEDNPGDEKKDLLYVQIEVKE

SEQ ID NO: 6064 - protein, 111 aa, Methanobrevibacter ruminantium
MLSKKEAIQMTLDNEKHYPVKCKYCGKPFTKSHNRQMYCSDSCRRNALREQKARYQAKRRLKIKQKVLIVDEYKKYGLGSYGTSANGHRKNNFSHEYMAIQKEMKRIGLKR

SEQ ID NO: 6065 - protein, 78 aa, Methanobrevibacter ruminantium
MMIYDKATVTSLIVAILLPLMSMLGIGELTQNYILAIVSGMIALVVWYYNEKHNSDLVSGTTKCDCELCYGGDDEALI

SEQ ID NO: 6066 - protein, 112 aa, Methanobrevibacter ruminantium
MKHLYEIIPYRRTVWITGFLKTTVSSAMITTGVVILFNSITEHPYFMEWDEIGIVLGIVSITIACIYIAMIDRWKERRKKEELDTIEDYINRKAEEIANMKVLRKLEELEEE

SEQ ID NO: 6067 - protein, 206 aa, Methanobrevibacter ruminantium
MTMIEISTIKITDIKPAEYNPRIMSQLEHTKLRNSMETFGVVDPIIINLKNNHIIGGHQRYEVLLDKSMEDNEFIKELHLIRLGDVGWAFPESDLEVEDDDHEKALNLALNNIEGEWDLPKLEPILTDLKDVGFDIELTGFSDIELTELNLENNLVFAEEFEPDESEEDVDLEDIYDEPVKEMLQCPACDHVDVVKRFKRVDSQGD

SEQ ID NO: 6068 - protein, 66 aa, Methanobrevibacter ruminantium
MKIYLAAADTMSEDIIRLLPVAKRLHWNLFSYYYLLTLKKMEDYDIIRKASKKRPYRQRSAQLPEG

SEQ ID NO: 6069 - protein, 218 aa, Methanobrevibacter ruminantium
MINERIRPYLNFSFNDKKVIFVTLFVVSNLISNLLAIKVFNLGFWGLTTDCGNLLFPLGYLMADVITEVYGERTARRVILLGLFANILLIVATTLTVYMPYPSYWTGQGAYAYMFGFTPRIVLAGFIAYLVGQFVNARLMVLIKKWTNSKYLFMRTIGSTLGGELCDSCICSSIAYYGIVPNSGILLFILMQYVVKVTWEVVMQPLTYKSIAWARKDG

SEQ ID NO: 6070 - protein, 491 aa, Methanobrevibacter ruminantium
MTAASRVNAHGTMGLGRWSIYINNGFWKPRDFDVLIIELLQYAIQGRVSGILLGVPSRHGKSTLISKNFCSYFLSYFPNEQVILSSYSQGLASEFGGQVKDIVNHYGYLSPYKPTIRSDSKAKNKFKLNEPYRGQMLSAGAGGSIMGYGAGLLIVDDPIKNVAEAESKVRQAKLKDWWGGTIKSRVQRRSNGLPPIKIVIAQRLHLKDLHGIIKETEPTIPANDAFRILRNGGSIDPNTWVDFNLPAICDSEDDILGRKIGEVLWEEQRDYEWLMAEKRSMGSYLFNSIYQGQPVERDGEIFKREWFQDEVNHKLTCLIDPKDIPKDLPQLRYWDFGASGDAGDGTSAILTSYDGEYLYVLDLVAGKFSSLKVLKTFKRLCKKDGKQTRVMVEQEPGSGSKLLIKKFRREEDLRGYNIRADKVQVSKKVRAFDLEGLAEDRRIKMVPAHWNNKLIDQLVAFTGEDGGEDDIVDTITGSCRFWTRPRRRVKA

SEQ ID NO: 6071 - protein, 441 aa, Methanobrevibacter ruminantium
MSKKQEMMRIERLKHYAYQTGLIIPIFKNHDLIKKIENGKITNTDEIKIYIEENEKQIKRRREFISIIYDNCKYFKYDSICYKLISKVNNFEIKSLEELMNEIESEKKKNGFRKNIEEKELIKENENKGRLKEYVRIVRREYGLDFTSVKKLKLKIDNNKIRSKEELNEEIIEEKKKTELRRIVYDSDLNWDLKWELESKIRHNEITTKEELIKEIRRIEFINIIYDNNRDFKLDYVTIQKLVSKIGSNEITTKEELIKEMTEEKKKGIERRTEYKKIVNEAHALDNTSQWKLELKINNDEIRNKEELMNEIESEKKKTELRRIVNDSDLNDTSQRKLLSKIDEDIEVITKEKLKKEIQKEERIIEYKKIVNEAHALDNTSQWKLELKINNDEIRNKEELMNEIESEKKKTELRRKSEEIIRRKKERSDSYHPNANKPWKF

SEQ ID NO: 6072 - protein, 552 aa, Methanobrevibacter ruminantium
MSKNAKADAFVVTTEDGSYDIVDADVLERYAIKSESDETGSKQLKTDGWEYDDTLLEPLYDPLQLCELLEINTYHENCVDVVARDSAGIGYDIVPVTGEKEKELNKPKLTNFLENIEPNINELLYQMNYDRRATGYGALELIRKDKSKSEPVNLSHISSYTLRRTSDGKRVKQRVGTKTVWFVIYGKNYDKEGNLCDVHSETGEFHPYNSLSKEERANELLWTMEYTTKSKYYGLPKIVGAIPAIYSDISRSKYNTSFFKNYGMPSFAVLVSGDFVDYGQEEFLEDGTKNPEYDVTKTLKWKISQQLKQAIKNPHSAVTILVPSEGEEGNVEIELKPLSVETKEASFRLFRQDNRDEVIHAHRVPPYKVGINETGSLGGSNIEGATINYKNDVVLPIRFNDEFLINQVIKNDFKIKDWRFKITEHDTRDYTTDIAIIKELFLMASITPRQIIENIGERFGLTASDNPFLDEYYLNNVPLENVWNGGDVPMEAETVLDSLENDLMKDAGVMDEQLREKRQTRDDGAQGASFKEADSEYQERIQKAFDTRRAVQ

SEQ ID NO: 6073 - protein, 775 aa, Methanobrevibacter ruminantium
MMALKVRHSKRQIQNIKREYRRRLILEEQCSREIADFFRRLERKIHKVMDEHWESELGLFHLNKVSDIIQDSRQEYYDILFKYCKDSYMKGREATERRFNRKLENISMKADVNITRLEDLFKPDPTIRYNLNNKVFQASAHTMDRVDNRIMENITQSYDDGLGIDEAKDRLTVEYNGLKSWEAQRIARTEINSAQNDGAFDVYGELGVEYHQWWTAQDERVRETPQADHRELHGKIVKVGNSFSNGLQYPGDRTGRIVHWINCRCTTLPFLMPLGKMAPPGMIEFTEEDLIDIPNFEMPTIDDLMRRYEAVEPKSQWILDDFEDLINLNEDEERRLAEIQEIFKRNARDNVPPSYIVQRQYDEFMLRKNFAENLRMLKRGQNPFLNESEKQMFIKDYSRFLKQYENEIRMNKELQKMYPKEFSKVAKDVDLQFYRENYNNQFSIYHPDDIRSFEVTSKTLTSEERARLKEIEKLYPKESKRIAKEMDLKYYEKRHPERFGRFMEEEERKRLAKIERMYPKETSKMANEFAPRDVSRLRTKEDIDLYEKNFIMNKSYRKKADEIVNGNGMTITRNVKYDLKGRYEDYINITDDTFDVLRFKDYNCEIWISSKSEVSTVEIMQTLDKIPRKLMNQNHNRIIFSADRDVYNLKKNHFVGGVTKRKDNEIVIFKCKEGILSQTKTLAHELGHAWDNNLSKIANRGGAYYKVAEEEGGFVTSYARKGFEVFKTHYSEDFAEAMELYVTSPEKLRRKFPKRYEFIKNMMEDDLFVLGLIPY

SEQ ID NO: 6074 - protein, 96 aa, Methanobrevibacter ruminantium
MDAINVINQNKILVDVLYRGTVNLIDIVIGDALVYDNPTVVVKCYTTDLAFATTEIDEIVLENEEFELLITYEDGEFSILLKSHNLGELGYIEWVI

SEQ ID NO: 6075 - protein, 109 aa, Methanobrevibacter ruminantium
MGNLGGFRMVFVDLCENEIADMVESFYRNGDGSSRILTNRAVGEIVEHYCSFEVDGRITTNLRDFLLYSVVLYDTIGEAVDDGVNLEEVFIIEDRNCYTGKSQVILIGG

SEQ ID NO: 6076 - protein, 188 aa, Methanobrevibacter ruminantium
MRKVVNWLKAIGDNFSVDYLLLALFSSGDLILVAIVLNSYGVISPENVRELVIDYISYRKVDIFWRHLRRPRMSFEDYVLDNFEEMETGELTREQVVEFVSRQERKGLTFCNEIFIAVPLKKGSKDDIVEILWNEYFVEDYKENWLEQHENLGWNDWKKLLKKEIVENGGDDFQIFRNHLIDCVLMEY

SEQ ID NO: 6077 - protein, 93 aa, Methanobrevibacter ruminantium
MDEFVETLFDTYWKVNENGEYMSLTDCGDFYIAKVAPCVRNWSIVIECNCFCFHCKEFVYHENGAILEIGMEISSLYLSQMEIKDLKIYMIDC

SEQ ID NO: 6078 - protein, 65 aa, Methanobrevibacter ruminantium
MECPCDNCEMLRENEPIKVIDWKSNSPFGMDLYHFEDGFRCCYNGEESLRKEDLSNHGCRLRGGI

SEQ ID NO: 6079 - protein, 62 aa, Methanobrevibacter ruminantium
MIERRRLGMKYDIFTILDEISRKLDDGELSDEQVDFLLQMEILVEEGTITDEQAQDVMNGDY

SEQ ID NO: 6080 - protein, 68 aa, Methanobrevibacter ruminantium
MYLEIDEVKCENIDRIEFDDVAMEIVLTDEKVYERIKRWLKSNEIDYDCREDRYFANLIEYVIRITWW

SEQ ID NO: 6081 - protein, 231 aa, Methanobrevibacter ruminantium
MVVKCPNCFSPRVSKCEDTNIKWQCDKCKCKFNHGAFDINAEMEKVEQLTIEKIERERERTEQFERAIKEAKEQFERERTEQFERERKERLEREKREKEREKIEKERERKERLERNRIKIEERERERIKRNERIRRENERNRIKSDKREREKSEEKRIKRNERIRKANERNSIKREKRERERERNVMTIDEYYRSIGYGSTGKSKVWSAIIIPILLVICIILILMFYGGGM

SEQ ID NO: 6082 - protein, 134 aa, Methanobrevibacter ruminantium
MISHIIVLLICFIGLVEAILMALVDWEDLAISVRKSPRKLYNVLKDELGLPEWNELSVIERRSMKKRYAVIRDSFPELPPWEELSVIDRRSHKRLYKLIKSVYDGDYDDSPSLEGPPAAVGPQKEIPLEEAEYP

SEQ ID NO: 6083 - protein, 1099 aa, Methanobrevibacter ruminantium
MPSSNVMNIIVKAEDMASSVAQKVENSFRKLGNTIDSTFTTSLSNTKFNQELTSFGTDLDKVTQRLKQVGVNGQSSFNQLTNAERRTLEKLSEFDPVSAQVLQHLSRIGITGQQTFNQLSVSEQKSLMNMKSTAQQLEEVNSKLRVVGIGAAQAANMLNQMKLDPSVGSNLDRAKLKVSEMGYSLDSTKGKILVLGTAIQTSLGNKWDSIKTKVQTTATNIRTALGNALTSVKSKVQNLGNAFSGLGGIISSAIGAIGMASISQLTVGLAMNRERMTALTNATMGGAKAGDQLLNGFTGVNKVFKDLNGNSTNYFMGLDEMTNHSLVSLDDLGQAMSTIKMSTGMSNEELMMFSSTVNDVGQRAILMGKSGEEAISLMQAAGRGLNGEFDMLKTNFGITKDTLTDLGWSGAADDVKGYQEALDKALEKGGDMDGMLDTTTGHLETLKKNFRVAGRHVGEMFTPYIDMAVQKLNGLKETCPGLFENLVMIAGAVSGFATVAPSIAPMISVFGDVGSAIKRTAGFLGLMEVAEDAVTLKSTFLTIAQIAGADAAVLQTAANSGLTASFWAMAAAILANPLTWVAVALIAIAVAVYEVGKSFGWWSDIGSMIGAVWAGIQRLWSAFINNPNVQGFLKDLSNAWNDICEALAPVIDWARKAWAELFPPSATGSFDIVRAIIDVFGQLGDFLGKVVNAVKSAWNALGGFAGFLPMLLGPVGMVVMALRMIVCILLGCSPGIVPALQKTQSVFMSVFGAIAEFIGGAVSNVVAILTRIISALTGIFTRVSSIVSTYLAKMISSVISWASSIVSKAKSASSKFLTNVVNYFSKLPSKVWNHLKNIIQKVTSWATSIVSKGKNAASKFLTAVVNHFSKLPGKVGTYVSNTASRISSGANKWVSNARSKASSTVSAVTGPISKLPGKVYNEFMGIGSRMLSAGSALVSKARQIGSNIVSGLLNAMNIHSPGTIQQKVVAEFENTLSRVGSMDSTALDVGQSVGNSIVRGFTDFGLDTGSFNADYSTDYNLNRKNDDNLDVNIKQELEFVFDFKNLPNDVDEDKLLEMLKEMVTDKSVIQALVSNPDFQSMDTKVKNSIIAKVKRARGV

SEQ ID NO: 6084 - protein, 505 aa, Methanobrevibacter ruminantium
MVEKITVSPQEVRGYGNVVDEKELEDYGSYRCDVSESSEVIKGVEERIFSVSGVPAPALSIANVTEDTRRGRCAHISASFEDGEGDGLDDKAISLKSGDDVLATITTGSGENVFDVVLYDSAQLYAVFDGDDYYPPAVSEAITVNPAKSLWDVEFILDEEEYEVGDTAILSGTVGTIVDEIVDGEIVTRRQMEANVTLTLVTDLGIRRCSTNANGEFVLQVPNIQQNQWRVVIAATSTHLVFNGLIDVPVHDYSLVISGSENSTAASTILVVGLTDFNSMVEGATISIAGSDGSSYTAVTDSMGGATVNVGRLNGATTFTATYGNVSSTVTVVPPLDWYDASNYTAGSGRMPSSRASSIYLQAVGGRWLNKEFTDSESYVLEFDLILSKNNREGFYFGANPNSNTNSGISIFKDISNTMIETFDSTGTAIRLESSLSGSYFNTGTHHIRIERDYDVAYIYFDEDLIFEFDDEILSYGAEDQMYNTVGILSWGSGIIEFGNFELSD

SEQ ID NO: 6085 - protein, 228 aa, Methanobrevibacter ruminantium
MVRFSRDMLQDGAKRMFKWLRKGEGLPNYLIMYDMDRNKEYKLVPKEYAGLYESRNIFWIKNGREPNYVTLTSVARNPLVMDYQNTNYTCCPTSLSLASQMLYHYKSESECAKALGTSKGSGTSPAQLIANAPKLGFKIIPIKRDSKEVKKYLKKGFPVICHWQVNQSRNCKGDYTGNFGHYGLIWDMTSTHYVVADPAKGVNRKYKFSCLDNANKGYRQNYYVVCPA

SEQ ID NO: 6086 - protein, 86 aa, Methanobrevibacter ruminantium
MDDETLILIEYIRNAPTREMVLKSFEGVDFIRPIQISRKTGIHPNNVSKKLKDLREHELVYVINPEYHVPKLYRLTEKGKNMLQFL

SEQ ID NO: 6087 - protein, 227 aa, Methanobrevibacter ruminantium
MMDLIFEYLIVFILLFATNIAFLLRYSSFNKNKFIPFVLGYAIIVFALTFVFSSLNLQKESIDFIPYILFAVSALMLIISIRYVGFGKNYGINDDKVVLYGTILSSFLSIGALALGLKSDNLFLSGLELAILSVVVIFLVYKISKIFNNAKRPYYAVIGEYMFLEFILLLILALTFSSVRELDYSMFGSFLILTPTYKVLYMIIAIVILLVLGVLYNDWVLKRLKRK

SEQ ID NO: 6088 - protein, 683 aa, Methanobrevibacter ruminantium
MVEIKYVPSICPYCGTGCGINFVVKDGKIIGVEPWKRHPVNEGKVCPKGNFGYQFINHPDRLTTPLIKENGEFREASWDEALDLVASTLKKYADTDPNKLGFYACARSPNENIYITQKLARAGCGTQNVDHCARICHGPTVAGLATTFGSGASTNGYDSIEEADFIFCIGSNNMEAHPLFGRKIIRAIKNGAKLVVADPRFTPTAKLAHEYMQFKTGTDVALMNGMIKIIIENGLQDDEFIKNRTKGYEEMKEVAMKYDLDKVAEITEADPEQIERVALEYAQAENAAIVYSLGITEHSHGADNVMSTANLAMLTGNVGKIGGGVNPLRGQNNVQGACDMGALPSDYVGYQKVANPEITKKFSDAYQIELPTTPGLTLVEMMNAAHSGDLKVLYIHGEDPVLSDADIKHTKEAIANLEMLIVQELFMTDTAAEADVVLPAAGWGEQEGTFTSGERRVQWLRKAQEPPEGTMLDWKIMEEIAVRMGRPRELFHYENAAEIWEEIRELAPSYYGITHERLLKPEGVHWPCLDPEDPCEPLMHKDKFAHPDGLGVFQALEHRGPVEVVDDEYPLLLTTTRILFHYHAAMTRRCETLDKEVPTGFIEINTEDAAERGILNNEIVKAYSRRGEIEIPARVTDDIKKGIVNIPMHFTECAANMLTNSDSFDPKCKMVELKACAIQVEKL

SEQ ID NO: 6089 - protein, 402 aa, Methanobrevibacter ruminantium
MAVNVNDMFYAYSGNEAIKEKGEYGGVVTTIMKYLLEEGIVDAVVAVEEAADLYDAKPILITDPEDVIKSAGSLHCGTLNLAKFVSKYLDGARDMKIAVTTKPCDAMTLKELMRKRKVIEENVIMIGVNCGGTMPPVPTMKMIRDVYELDPADVIKEEISKGKLIMETAEGEKAISIDELEEEGMGRRENCQRCTMNIPTNADLALGNWGVIGELAGKATFVEVCSEKGADILDKVIEAGLIETQEPIEKGVTIRANIDGIMVKQAMAQREKDFAGTSGDILEVFAEYKEEFSKCMKCYGCREACPLCFCDDCCLEAEGPEWVPGGYTPAAPFFHLTRMVHMVDACTNCGQCSEVCPCEIPVSKVWATVNQKVRDIFGYYSGVDNEEPLPFTEFGPKSYRQY

SEQ ID NO: 6090 - protein, 235 aa, Methanobrevibacter ruminantium
MRIISIVGLKNTGKTSLTSKIIKELTNREFKVASIKHSHHQMEMDHEGTDTYKQMESGSDFVVGIGGRTYFNINERLDLERILFLIKLIENPDFVVIEGFKSYPYAKIATCKEVEDEYTIKTVNSFEITDEELLDLVDLIEERSYDILDTLFVSDCGYNDASIIGQAFAQGKLDYNPDTQAEVNLAIDGINIGLNKFVSNYIKQTVLGILNPLKIKEYGVEDFENIDLTIKNKKD

SEQ ID NO: 6091 - protein, 61 aa, Methanobrevibacter ruminantium
MACNDDFENNVTLAINGNDIELNKFTDDIIKETILGLLKAIKTSEYGVDEVKDVEITIKNE

SEQ ID NO: 6092 - protein, 311 aa, Methanobrevibacter ruminantium
MKDKVRDDYERPIISLRISITNRCNVNCIYCHHDGMLDSSSEMTPDEIYEICRIAKKLGVEKIRLSGGEPLVRPDIVEIVEKVNSLDFRDISITSNGIFLDKLAGPLKDAGLDRINVSLDTLDEETYKMIVGKNVLERVKKGIIESCAVGMYPVKINMVVMNNINNDEIMDMFEFTKKHGVILQLIEIIESESCDDNDFNSKYHYPLAEFEKHLAEIADEIKVREFMQDRKKYFIDGGEIEVVHPVDNTNFCKNCTRLRITPEGKIKPCLLRNDNLVNLIEFIREGASDEELIDIFLKGIHNREPFYKEEN

SEQ ID NO: 6093 - protein, 2309 aa, Methanobrevibacter ruminantium
MKIQRGIYIILTLLVLFSLSAASAADDLTDDIISADENEELILDETVIDDVSNANDNYDEELIKANDEKFVYAGNDSDELREDPGTYSGLSSEIGAGGNIVLTHDYYTYDSGDTIIISISNSVIDGNGAIIDMAGSTIRAFKVTASGVTIKNLTIKNANVTTDDLGNTDDEGAAIDFEKSGTIEYCNFINNSANAAGAVYFYKDNSKAINCNFSYNQAVYSGGAVCFEESGTIENCTFVNNTAVYDILGGGGAVCFNGTGNAINCNFTNNTAQGYFSWAGAICFNTNGNAINCTFTNNKAHDSGGAIEIYGNGKLENCSFDKNSANDGGAVKIYGATKISNCNFTENKAAELSGDGGAIYWNASAGKLENCSFAKNSAFHGGAVSFEEDGEVTNCNFTDNLAGDSGAIWFTADGTVENSTFIKNEAWDEYGGGIVFYTSGDVRNCNFTDNEADKQGGAVYFNGAGTVENSNFTNNKAQDGGAIFFSEDSTVKNCIFVKNCATDIRSDRYFERCKYVFYKNGEVTNSSFTENNATEGGAILFKGNGKATDCNFTNNSAKFGGAIDFESHATVENSSFNGNKASSNGSAIWMNRAGGIVSSSVFVNNRANTGTIFFRNDNSTSHLTINDNIFLNNNGVAIYFDKNDSDSNTDYNWFGNNATNYDIAPVANNAEINTWLFLNTTVNPDMISILDSLDIAFKLYAYTPSEVSEYDNIRLKAVDLTLTPTNGIFNTTKTELGKTVQYIPESDGIGTLTASIENASYTTTLKITDGTTFFDLDYIINANNNNTIVLDRDYTYNSTFDYNFTDGIVIDRPVTIIGNGHTINAAEMVRIFHIQADNVKIKNITFTNAISNGYGGAIYWQGANANLSSCLFENNSAVMAGAVAFYGSTGSIVSDCSFMNNSANNGGAIMWQVSDDSVVSDCSFMNNSAIQGGAIYWSSNDGVVSDCSFVNNSAVRNGGAIYWEKNNGNVSGCIFVNNSADNGAIYFNNQNFGQNLTINHNIFLNNDAVAIYFVRNDSASNADYNWFGNNATNCDIAPTSNNMEMNTWLFLNATSEPEGISILDSCDIIFKLYAYAPSGVSEYDSSRLKEINLTVTPTNGRINTTQAKLGEKVHYTPESAECMLTASIENAFYTTRLKISDGTTFRDLNNLINRNDNDTIILDNDFIYNSLFDSKFKNGININRPLTIVGNNYTIDATGMARIFRIQADDVEINNITFANAKIDGNGGAIYWYSGARGIVSDCSFVNNSAKMYGAAIYWNGANGNVSDCSFVNSTVTDEHGGAIYWHGANGVVSDCSFVNNSAKKYGGAIFWNAANGVVSDCIFVNNSAKSYDGGAIVWNEGLNGAISDCSFVNNSANDGGAILWNEAAGGTVSNCSFVNNSANKSGAAIYWDSGARGVVSDCSFVNNSANRSGALYWFANDGVVSASIFVNNSGDNGVLYFNNTNKRNLSINDNIFLNNDVVAIYFVNSDSTSNADYNWFGNNASNFDTEPLTTNVEISTWLFLNATADPNPVEILNSSDISFKLYSYNATGISDYDNSQLQPVNLTLTATKGDVDSIAKLGETVIYNPTSLGTGSVTAKVENVAYSIEINNIKSNPNLSVESDELTYGNNIAIALNYESAATGKVNITLKGKKSDYTFADLDLNETISLGILAADEYEVIVEYSRDEIYTNASARGTLKVNKANSTLTVSDIEFDYKDMGSGEISFTNATGVEAKVINHDEAIVFVRGNTITVLNLSADSYILEVTTITDENHNEVSKNATITVRKVNSTINVNDIVLYYGESINLAVTTDGAIGISADIDGENVELNENIVTIPDDLESGNHTLTITTVPNDNHKEASKTVNIVDCRIGNITVVVDGVEYSIPAVNGTAITTNMPEEIEKLKENITDLTGQLEEAQTNATNLANNLTIANQIVDKLIAQLEEAQANATQTINDLTHQLNEAQTNATKIANDQTNANQIVDNLTGQLNDAQTNATKIANDLENANQIVDDLTRQLEEAQANNDQTINDLTHQLEEAKVNATKIANDLENANQTVDNLTTQLEEAKVNATKIANDLENANQIVDNLTDQLEEALANATKIETVVVDGKEYPIEYVNGTATVTTNSTGPQNITHERKATQIIYKDMETTAIDTKVDGRIGKYFNVILKDSEGNILANKPIQIGFNGKVYNRTTDENGSAKLQINLIKADIYTFAICYLGDDDYNGSFVVSKITVKAQKGTLTVPNKSYKATTKTKTLSATFKAASGKVLANKKVSFVVNGKTYSAKTNAKGVATVNVSLNKKGTYSFVAKFAGDNTYAAVSKKAKLTIK

SEQ ID NO: 6094 - protein, 100 aa, Methanobrevibacter ruminantium
MVKEILMDPDDIIEYVRNEVKVDDIFELSYNRVFAPGTVLGITPEDEETGEGLILSLQLNGELLNQAVDIDLHAVKDEIIEARHLPGGDEDKLIVIEATL

SEQ ID NO: 6095 - protein, 100 aa, Methanobrevibacter ruminantium
MVDKELTMTSDEVLDYIKNNFKEFDKVDIAYNRVSAKGDILGVDLSDYKGKPSCRVMIALDGEIISDTIEVDFEEYKEDIIELHHWPKDESKESVYIEVI

SEQ ID NO: 6096 - protein, 345 aa, Methanobrevibacter ruminantium
MSEKFLKVNIQKELKEFELDIDFKLNKGCLGILGPSGCGKSMTLKSIAGIVNPDTGIISLKMDEENIYFDSEKKINLKPQKRNVGYLFQNYALFPNMTVEENIGIGVSKEKREKTVSEMIKRFHLEGLEKRYPRQLSGGQQQRVALARILAYGPDVILLDEPFSAMDTFLKEQLRIELVNSLKDFDGFSVLVTHDRDEAFQFCDELIILDKGKIIAKGETHEIFENPKKLDVARLTGCKNTSRIEIIDDYHLKSLDWGLTLEVSEKISPNITHIGIRAHDFAPAKKDEVNSFDTENSSLLEMPFEWEITLANGLWWKREKQIREHEFVVPDHIKVDPKNTILLEE

SEQ ID NO: 6097 - protein, 564 aa, Methanobrevibacter ruminantium
MSESEHRMIEILRILNTHEKPIGSKVIADELKTKGYNLGERAVRYHMQILDEKGYTEKQGYSGRVITELGKSKLEKGLIYDQVDFTLSKFKERIYLTDFDYKKKEGNVIVNTSNILENKAFDIIKEVFAAGVCVSPLINAKKTEINGKKGYVMKTICGTTIDGVFLKNGIPSIPQYGGLVDIEDYYPTKFSELISYRKTSITPLDAFIAKGMTSVLEVAEHGTGTIPANFRIIPESGLEKAKEIFEKLEKAGIGGILEIGEISENILGIPVPEGMVGISIIGGITPFCAAQEMNYKVDIKTGEEFINYNKLKELESSKHKIKHAKKVDYKKTPFILTKSLNRVNQVDYDIETGHGNIVSNISYLQKEDLDDAISIMKKTYKALPKYMNSHFSIVDHPDDKSKVGIATVCSLSIDGILIKNGIMSTPQYGGLLELGKPPLFVEMISYNGSSIDPHKIFIFKDLTQIAKRKNPKKILASIKEVPYIARPETEEILEKISKEGFSIFKVGKPRELVYNAKVDNYNFGIVTGSGLNLIAAIKEKGINIEAKAVETVLPIEDMSLIYEQ

SEQ ID NO: 6098 - protein, 448 aa, Methanobrevibacter ruminantium
MEKRIQNIMERMKADNIKFIRLQFVDLHGIPKNVSIPCELDNMEDLFTDGILFDGSSIPGFVGIEGSDLVLKPDISTYSPLSWRPEESASCRFICDIYNPNGEPFEGDPRGILKKALAKIKEEGYTYNIGPEPEFFIVDTDDDGYPIPHDTAGYFDVEPVDKGTDFRREITTNLQELGFEVEASHHEVGSLAKTKSHSSSDDALKTADAVITFKQAIKAIVANMADFDGFDYRVTFMPKPFFGESGSGMHCHQSLFKDGENIFYDENSETGLSQEAMWFIGGLLKHSAAITAVTNPIVNSYKRLVPGYEAPVYITYGIQNRSTLIRVPAARGKATRIEYRSPDPTCNPYLAFAVMLEAGMDGIKNKIDPGESVEINIYELTDEEREEKGIELLPSSLWEAYHTFEESEIMKEALGEHIFNAFLSAKYEEWDEYRVQVFNYEHKKYLNY

SEQ ID NO: 6099 - protein, 4187 aa, Methanobrevibacter ruminantium
MNDKTNDFFSEYLSGLCLDFDESTLIAPNKNGEKEKCIIEKSEYEIKKDNLVGFAKSNSISINELILASLTLTLNKFNFSNETLIFNQNNVPFAAKFENRQISIREFLEKIHENYIKTLEFDEYFDKDDLPLNPEFYFTFDEDLKSDAEYSNYLSIVENDETVSLFLSYNDELYTKEFINLFISSLEKILEEIATSDIDKTNICDIAIVGENEDLIFTEVEMPLIHRRFEKQAVEKGDEIALVASDATLTYKQLDEKANVIANALIAKGVKPKSNVLVMLSRDSNLIASILGILKAGCAFIPIDPEYPQERINYIYENSQADYIIANESGEKSLDIEELLKDGNSDDPELDVDPDDLAYMIYTSGSTGNPKGVMISHKNICNQASNPKSTYESLLCITTISFDVSVDDILTSLSNGLKLVLADDVQIKNIPALIKLIDENKPEILEITPSRMGSYLEVKEFCNVISCFKCIFIGGEKFSSKVYEDLRKYSDAVVYNSYGPTETTITSNNKAVTDVNDLTVGLPHINYVTDVRDIDGKLVPDGVMGELYIGGTGVGKGYYNMPEKTAEVFLTINNIPYYRSGDYAIKLPNGEIDIKGRIDNQIKLRGLRIEIGEIESNVGKYPNIKQAVVVIKEINDNEHLCAYYTADEEIDSDDLKEFLKDRLTRYMVPTVFMQLDEMPQTPNGKTDLKQLPVPQLKLSFTLPESETEIILHEIASSISKTKEFGTTDDLYAIGFTSLTLMKLNARIYEEMGVNLDIISLLNDPTIKNIAKEIENNDILDLNGVIESSKDMVYYPLTENQMGIYYECIQSGELAQYNLPSVIRFGSEIDADRLHDAIIKTIEAYPYLKTRIVLEKGKVMLKRDDSIDIDDIPIINVDSISDEQIEKENLKLFDLHNDQLFRFKIYKTPSETILFSDVHHIISDGESLDKLFTNISNAYQGIEIEKETINGYINSIIESENENSEKYELSRKFFQDKLTQEIDSTVLTPNLNGNFEEGILKSISKNIDSELVNRFCSENRITPNVLFMAVTMLNLNKYTFNDKTLITTIFNGRSNSSYINTQALLVKTLPIVSINDDRTLSFKEYLSSVNDIWMETINHSDYPYTKISEEFGLKPEFFYAYNNLDAEEIAIDGKTYKVKYLKSLEVNYKISLEVNETWDNIELFLEYNDQLYSADYIDTFLNCIIDVINQLIESDIEELSIGEIELGKGIETPLSFTPVDMPILHKRFEKQVTDKGDETALVASDATLTYRQLDEKANVIANALIKRGVKPKSNVLVMLSRDSNLIASILGILKAGCAFIPIDPEYPQERINYIYENSQADYIIANESGEKSLDIEELLKEGDFENPDVDVGPDDLVYMIYTSGSTGNPKGVMISHENICNQVSNPKSSYDSLLCITTISFDVSVDDILTSLSNGLKLILADDVQIKNIPALIRLIDENKPEILDSTPSRLASYLEVKEFCNVISCLKCIFIGGEKFSAKVYEDLRKYSDAVVYNSYGPTETTITSNNKAVTDVNDLTVGLPHINYVTDVRDIDGKLLPNGVMGELYIGGTGVGKGYYNLPEKTQEVFLTIDGIPYYRSGDYAIQLPNGEIDIKGRIDNQIKLRGLRIEIGEIETNIGQYPDIRQAVVVIKEINNNDHLCAYYTADEEIDTENLKEFLKDRLTRYMVPTVFMQLDEMPQTPNGKTDLKQLPEPQLKLALVMPESETEERLYDIVSSLVDADEFGITDDLYAIGFTSLTLMKLNSIVYEQMGANLDISILFNEPTVKNFAIEIDNSFEKDSGLEELIESAKGLEYYPLTENQLGIYYECMQNPDVIKYTMPTTVRFDSDLDANRLKQAVIDTIEAHPYIKTRIVNNDGELRQKRCDDVAIDDIEIVKVDSISDEDIVRNDVGPISIEDSQLFKFKIYETPDEIVLFSDFHHIITDGVSQNNLFRDIADIYENREISEEIIDGYIYSLLEKEAENSEIYQSAEAFFDDKLTQGIESTVLTPDLNGNPDEGKIKNLSYAFDSELINEFCNDNSISKNALFMAGTILNLNKFTFSDKTLITTIFNGRSSPSYFNTQGFLVKTVPFIINNENRQASLRDFIKSIDQSWKDTLTNSAYPYIKIAEKYQLKPEFFYAYHEFLESDEMMINGKEYIPQELAGVDMVTVESKINLAVYDNGDEFNLILEYNDQLYSEDYVKTFIESLKSILVQFLENDMDNYRICDVKLKDDEEVHEFVDVEIPFIHKRFEKQVDEAPEKIALIASDGSWTYGELNQKANRVANALINKGIKANSNVLVMLPRDSNLISAILGVLKAGCAFIPIDINYPRGRIDYIFENSQADYLIADRGIENSIDINELLQEENASNPQVEIDPDDLAYMIYTSGSTGNPKGVMTSHMNITNLFSKDEGSVIYNAYSKMKRTLALSTVSFDAFLLDFMPLTFGLEVVLANDSEIKNIKELAELVKREKPDSLTFSAPSRFKQYLEYEEFAKQVPDFRYIGLGGEMVPQDLISRLLEYPNLELYNIYGPTETTVTCNTHKLSDAENITVGRALHNCITEVRDIDGKLVPNGVMGELYIGGKGVSRGYYNMEEKTKEVFLSINDIPYYRSGDYAIELPNGDLVIKGRIDNQIKLRGLRIELGEIESNIARFPHMKQIVVVIKEINNAEHLCAYFTADEEIDIKLLKRYLGNKLTEYMVPTVFMQLDEMPISPNGKTDIKRLPKPKLNLDYVEAEGETEEKLVELVSSIANTTNFGTTDNLYELGFSSLTLMKLNSMIFNEMNVNIDITSLFTNPTIKSLADKIDNNIEFEIDIDEIIETAKDMDYFPLTSNQMGIYYECMQTEKIKYTMPYAIRFESSIDPYKLKDAVIRTVDAHPYLKTRIINTDDGKILQKRCDDVEIEEIEIVEIDSISNRQIMDRDIKPIPLDDNQLLRFKIYKTPTETILFADFHHIITDGVSQGIFFNDLAKAYNNEEIEAEKIDGYEYSLIEEKISLSEVSENFFKKQFSQGIESTVLTPNMNGNPDIGNIKLISDQVGSSFVRHFCKDYSISPNVLFMGATLLCLNKFTFSGKSLITTIFNGRSNSNYDNTQGMLVKTLPIIVNAENRDMMVEDYIKLVDKAWKDALTHSNYPYTKLAEDYQLKPEFFYAFHESLKSKVELDGRTYEAIDLDGTVSTDYKINLDIFDDGEFITLYLEYNDQIYTEEYVNQFIRSIKYILFQFFVHDMDKLRIRDIELVEGEIPEFEEIDTPIIHKRFEKQVVEKPGDVALVASDATLTYGDLNEKSNRIANALIRRGVKPRSNILIMLKRDSNLIASILGVLKAGCAYVPIDPEYPSERINYIYENSQADYIISYETSENSLNVYELLEEEIVVNPNVEVLPDDLAYMIYTSGSTGNPKGVMISHKNICNQAQNPKSTYDSLLCITTISFDVSVDDILTSLSNGLKLILADDVQIKTLPELIKLIDENKPEALEITPSRIGSYLELEEFCNVISCLKCIFLGGEQFSAKVYEDLRKYSDAVVYNSYGPTETTITSNNKAVTDVNDLTVGPPLKNYVTDVRDIDGKLVPNGVMGELYIGGMSVGKGYYNMPEKTEKVFLTINGIPYYRSGDYAIQLPNGEIDIKGRIDNQIKLRGLRIEIGEIESNIGKYQDIRQAVVVIKEINNVDHLCAYYTANCEIDSDDLKEFLKDRLTNYMIPTVFVQLDEMPQTPNGKTDIKRLPQPKVELNYVAPKTRLEHEICAIFSSILNIETVGVEDNFFEIGGTSLIASKLIIELLKQGYSVRYDDIFRNKTPRALAKLLSGEDIGEEDLDLTDDIIKNYNYGEINELLQENTWENFFDGENLELGNVLLTGATGFLGIHILYEFIKSEEGKIYCMLRKGKFDSCQERLIDVMNDYFDEDFTDLVGSRIIPIEGDITEIDDFKQLEDEPIDTVINSAALVKHYTADDYIFRVNVDGVINGLKFAQTRNNIKYVQISTISVLSSYSLNEEAYPNQEYDERTLYYEQDLENKYVCSKFLAERAVLQAATKGLPVKIIRVGNLMSRYSDGVFQKNYDTNAFLNNIKTIKKLGAMNPAMASEKVDMSQIDYVAKGILALSKTPEKSRVFHCMNNHYISHRDIVDALNTYGYGIEEVDFEEFKQIYEQNMNENIQGIITADFSIDDFDEEDDFEENVEIEQTVDILHSLGFDWPEADEEYLKRLFDYLNKFDYFE

SEQ ID NO: 6100 - protein, 249 aa, Methanobrevibacter ruminantium
MPERYKGFGYWDIATRQMGIVSKSQQTRFKDAKVAVIGCGGIGGETILMLARMGIGELIIVDKDEFDLSNLNRQAMSSIDTLGLSKADVSKEKVRLTNPYTKVTAINEFINEDNVEYFKDCDVILDALDNLYTRVILTRFARENGIPYVHGAIHGTKGQVTVFTKDTKSYEEMFSLPSLGKELGEETKEEISKLTKGVPPVIGPTPNIVGCLEAFEAYKLITGIGEVTYAPKILNFDLLNLESFSVLEL

SEQ ID NO: 6101 - protein, 389 aa, Methanobrevibacter ruminantium
MKYRTLGKTGEKVSILGFGAMRLPHFETNDQIDVKTSDEILSYGIDNGINIIDTAYSYHANNLSGKGKCEEYIGNFLNEHSYRDEVLLTAKMPSWLIETKEDMEKIFESQMKDLQTDCIDLYMLHSLNEDYWKMYREIGAFEFMDSLLESGKVKHIGFSAHTEMDWIVDIVDDYDKFEFGLTQLNYLDERYQSGREGVEYIHKMGLGTMIMEPLRGGRLIQNIPQDIMDLWDTAEEKRTPLEWAFQYLWNMEEVDTVLSGMNSIQQVKENIEIANKSEINSISKNDLNLIKEVAWEYKQRKGNDCTGCQYCMPCPHGVDVAGCFREYNIAKMLNNPAGSAMHYFSLESDTRADKCIHCDDCLYHCPQMIHISEDLKKVDEFFGRKYDYF

SEQ ID NO: 6102 - protein, 498 aa, Methanobrevibacter ruminantium; identical to SEQ ID NO: 5951

SEQ ID NO: 6103 - protein, 81 aa, Methanobrevibacter ruminantium
MKRTINERWELWYNRILPYIIIFDFILITVSLILNVSEPTMAHIEHFDLLVCIILLGEFFYFLYKAPSKKKFLLDRDIFCF

SEQ ID NO: 6104 - protein, 89 aa, Methanobrevibacter ruminantium
MPVNFPGTILGYLRMLRLIRVISFARMGSFEDFFKKTEFHKIIIAIAIIIMTFTALFYVFGTSYNPFDYFYFVIVALTTVGFIDKPLKK

SEQ ID NO: 6105 - protein, 128 aa, Methanobrevibacter ruminantium
MTIKRKFDKLPPYCQFEKNLNLIKNKWTVYILRDMILGKKYFSDFKEDKPELSNKILTQRLKELEENNIIEKNIKDNETSYHLTEKGHRLQNILYELAIFNLEEEYHGEELEKIKKEFEQLKYGGNQK

SEQ ID NO: 6106 - protein, 266 aa, Methanobrevibacter ruminantium
MKEKIFINGRGGCGKSTFISLIAKELSKNNKVLIIDMDEGNLGLNKMLNVDVADTSLMEYYGGRDKIMGEILKVGIKGMVLEKINLKDDAASDSIDILDNMKLSDLPSDYVTWNGNIGFIESGKINDPDEGCACPMGNLTRDFLNHIELQDNEVILVDTSAGIEHIGRGVIESADKLISIVDPSSDAILLANKIGSLSKEASKEYMVILNKIDENTKDLVLEQLDDDISVVGELEYNSHIAQSNLSQKEINLEEVEGEIKEICAKI

SEQ ID NO: 6107 - protein, 72 aa, Methanobrevibacter ruminantium
MYKVWKNCIGCGECAKACDFNLIQTFDDYILMDIEKCRHCSKCVETCQNNVFTKSVIFKHFLYLLYYKIKKS

SEQ ID NO: 6108 - protein, 135 aa, Methanobrevibacter ruminantium
MKIAIRYYSKTGNTEKLAEAIGEAIGVAPKTIDEPLNEDVDILFLGNSVYNAGADSKVKEFLKNIDVNVGSIVNVSSAALIESTYKQIKKEAEKCGLNMDDREFHCRGQFKFVHRGHPNEEDINEAVNFAKSIVR

SEQ ID NO: 6109 - protein, 181 aa, Methanobrevibacter ruminantium
MAKYIVINGSTRKGNSYAIANFIKEKIDGDVEIFNIKDKEIGFCQADNACKAKDECIVQDDAYDLINDLEECDGAFIITPIFFGRLPGMVDALIDRFYSKFNPAKEMKAPDESKKIGIVFSYGGGEADYTPVAEHVAFEFGVLRFGAHKNVMCSENNDPKGFESKDDQQSQINELISWVCE

SEQ ID NO: 6110 - protein, 233 aa, Methanobrevibacter ruminantium
MSESDEIIKRLDRIENELITIKENNYNQNLQTAIESIRDTYSNSIKKNFADNLGEKCSEFYLPNCKNEECKQFIVQEFKELFLNTQETDLNKLNEQLDEKFYSVCGVECSPCYNNFKEYFFEELKMINSINVSYELNENEPIEKLDVDMLISDVFEPLSSKQRVIIIESLYVENKSYTQLSHLTKLRGGNLLFHLEKLQDAGLISQKQDRGEYLLTKKGYTTLSLINQFQKLM

SEQ ID NO: 6111 - protein, 631 aa, Methanobrevibacter ruminantium
MEIIDLFGAALTGVKEQNVDLLFKSGLYMLMYTVISMIAVYVISFLTTRVASKSAYTVREKIFHILMNLPREEIDKFKISGLVTRSTRGMSSEQGFIVMILEQLMLIPVTFVAIVYEIALIDGTYALFFLGFIGVLSAIIIFRMKQIVEIFFRAKKTYGKLNLLFLSKINDIAGRIPFNKQEYEVEFEKACENSYDKNVIYIKSQCYLGPILMWGLYVIVLVTLAMVNSGYTIGFETDSVIDSFIILVYVAYFITTLANIPALIDRWPRAYATSVRLEEVLNIEDKIIKSNTNDNLKEIEIVEEDIAQEAKGIWDERKGISEKFTALLKEDKAKVRISMILLTISTLCMVYAPKVAGKTVDLLASNWNSTNDPAIYISLALLLVLYSVGYLFKLPPKRIMGATGEKVAYDLRVKLFDKLDAVGSDFIQENSKGLVLSRLNNDVMNIREFVSSKFTEIYAQILFIVFVIVLIVMTDFRLSLIYLVILPVYAVCFYVCDVKSKNYYDGHQMQLGRLMSYFERGLSNRDSFHEKGFKKMNQTVIDYYVKSKNVTNFMVPVTTLLTNISKITVYIAGIYFLAGNEIQIGTLLAVIMYGQLLTDPIKKLSSSMATIETSFSSIKRIFAIIDYKNDK

SEQ ID NO: 6112 - protein, 347 aa, Methanobrevibacter ruminantium
MPEFKLIEKLLYKSEQNDIEAEFIIGNETLWSSQKVIAEIFGTTSANISMHFSNIIQEGELDEKEVSISSKDLFKDNPNFIKKSLKKSNNRGRPQKWYNLDAIISIGYRINSKEATQFRRWANKILKEYMIKGFVIDKELLKKGGRFTEDYFDELLETIREIRASERRFNQKITDIYATSFDYNKDADITKEFFATVQNKLIFAISNHTAAELIETRSDIENPHMGLTTWKKAPNGKILQSDVVISKNYLNQNELSRLNSLVEGFLNLAESRAEDRIPMGMKDWKELLDDYLKLRRLPILVGKGKISAEEAREHVLEKYEKFRVVQDENFISDFDQMILDIKRLEGK

SEQ ID NO: 6113 - protein, 44 aa, Methanobrevibacter ruminantium
MKLVKRNQKLHDPDSPLLIGDVKDGDVVNEVNEPSYIDLQTKLF

SEQ ID NO: 6114 - protein, 110 aa, Methanobrevibacter ruminantium
MNNIAYLLLAILFETSATSLLKVAEGFTKPLPTIASIILYILSFYSLSNCLKTAPIGVAYAIWSALGIVLVTIVGIIAFKQTPDWAAILGLLLIIIGVGVLNLFSKMSLH

SEQ ID NO: 6115 - protein, 128 aa, Methanobrevibacter ruminantium; identical to SEQ ID NO: 6105

SEQ ID NO: 6116 - protein, 266 aa, Methanobrevibacter ruminantium
MKEKIFINGRGGCGKSTFISLIAKELSKNNKVLIIDMDEGNLGLNKMLNVDVADTSLMEYYGGRDKIMGEILKVGIKGMVLEKINLKDGAASDSIDILDNMKLSDLPSDYVTWNGNIGFIESGKINDPDEGCACPMGNLTRDFLNHIELQDNEVILVDTSAGIEHIGRGVIESADKLISIVDPSSDAILLANKIGSLSKEASKEYMVILNKIDENTKDLVLEQLDDDISVVGELEYNSHIAQSNLSQKEINLEEVEGEIKEICAKI

SEQ ID NO: 6117 - protein, 275 aa, Methanobrevibacter ruminantium
MDLLFYVVLLLIGGCFAGFMAGLLGIGGGIVITPIQYYLLTSIGCDPKTSLTVTFATGLAVICVTMINSTRKHKQNNLIVKQHLKPMMVFGFVGAILGAVISQYIDVEVLKILFGVICIVSTVFLVLIKSPTSLDNIKTDAGLFYSIAFACGLASGLIGPAGGAFIIPIFVAYLRYPITNTIGTTSALSIATTLAGVICYIVLGWGVQGLPDFSLGYVNLLQFVFLTITSIIVSGYAANLSKKINPTKLKALQVIVISYIGLQMMGVFDIILSII

SEQ ID NO: 6118 - protein, 72 aa, Methanobrevibacter ruminantium; identical to SEQ ID NO: 6107

SEQ ID NO: 6119 - protein, 38 aa, Methanobrevibacter ruminantium
MKLVKKNQKLHNPNSPLLIGEVKESDDVKEVNEPSYIY

SEQ ID NO: 6120 - protein, 275 aa, Methanobrevibacter ruminantium
MEIMEIIKDSFLFPSKNLGTFSIYVVLSVLVATFTFGGIFSYLLGFIGSEYILIGGLTLVFAMLIGWVMSGYEISIIKSGIDLDDEVPEFKWWDNFITGFLNFIVAIVYFIIPAFIVGVVGYLININDKLMAVAQEISSLYPNIFLTSSPDIAFEALSQAIIELIVPLAILIIVALIVFVIFLFLQSMAEARLANTGSLSEALNIFEAAKDIKRIGVRKVIIVILLVFVIIGVIGMVTSVIFNYVPTLSILSIIISPYLVFFAQRATGLLYSDIA

SEQ ID NO: 6121 - protein, 506 aa, Methanobrevibacter ruminantium
MNETIKENSWVPLIVVALASFIVALDATFMNVSISQVVVDLNTDVSTIQSIMSFYTLITAAFMLLSAKLQDIVDKKKLFLIGTALYGVGTFTASISSSAGMLFVGWAAIEGVAGALMMPATVSIISGTYSGEKRTVALAIVGVMGAVAAAVGPLFGGVMTTFLSWRYGFAVELIIVFVILIFRNSIPHFEPTESRSDLDISGAIISFIGLVLLVLGILSLSKDFTTSIGIIVVGLIALVAFAYFEIRRKRNGKVPLLDMELFKDRNLRVGTIILLLSYLAMGGGLFAVSLFLQSVLQLNAFNTGVTTLPLTLGLLIFAVLAPSLTEKLSHKKIMAIGCIMAIIGCLMLSYQFRLDTTLWTLLPGLLVLGAGLGFIMALCTDISLSNIPAESQNNASGVNSTGTSLGESMGTAVIGIILILGVMGGISTAVDTYAPDHSGDEQFQLEVANYFQKVATIDDLKQDSTLVDVANIIIQNTMAFVMQVTALIMGVVFLLTLRLKDNKIKQ

SEQ ID NO: 6122 - protein, 416 aa, Methanobrevibacter ruminantium
MSNVKDMSLADEGIRKIKWVQKHMPVLEHIKKQFEEEKPFEGITIGSCLHLEPKTVNLGLTLQAGGAEVAMTGCNPLSTHDDAAAGAAALGLHIYGWREQTDEEYYEAIDNVLSHKPDVIIDDGADMIMYLHEKRPELLENIKGACEETTTGVHRLEAMHADGALKFPVIAVNDAYTKYLFDNRYGTGQSSLDAIMGTTNMLIAGKNVVVCGYGWCGRGVASRAAGLGANVIVTEVDPIRALEARMDGYRVMKIREAVKIADLVVTVTGNIDIIHGDDFKYMKDGCMLSNSGHFNVEINRGDLEAQSVSCEEVRESIEMFTMKDGRKIYLLADGRLVNLAAARGQGHPAEIMDMSFAVQALSAKYIVENDLSLGVEKAPDSIDDEVARLKLKAMGIEIDDLSERQKDYLADWREGT

SEQ ID NO: 6123 - protein, 221 aa, Methanobrevibacter ruminantium
MSYFRYIDNGEGPTKLFIGGVHGDEGKHVLPLIKLLKREDFSSGQIYIYNFDRTPYISTIHREFYQSEQGKKILDLVDYYKPDFYTELHSYNIKHFDRLTSLDRLDSEGIPPLIDCGQYVLCSSVSPLIRRKHFTKEAICQTLEFPIFRGEDLKLSDDELLEKYDFDYDLSVKEYMAFLRLITLSKNRDDFEKRVLKDYKKQADLALKYVKIIYGLNFPRY

SEQ ID NO: 6124 - protein, 328 aa, Methanobrevibacter ruminantium
MGVKFKDIVTAEEINLKDLEGRTVAIDAYNTLYQFLSGIRQRDGSPLMDANGNVTSHLSGILYRTASIVDKGIKPVYVFDGDVSEYKTKTVEKRRALREEANQKYEEAKAAGNIEEARKYAIRSSRLSPYIIESSKKLLEYMGIPYVQAKGEGEAQGAYMVKNGDAWAVASQDYDCLLFGAPRIIRNLTLSGGLSNLEYLELDKVLTEIDLSREQLVDVALMVGTDFNEGIYGIGAKTGLKLIRQNSLEDILVQKGITDVEVEPDELREIFLSHDVNTDYKIKFKSADKEKLCEFMCEEHGFSETRVLNVADKLKKLSSTQKSLEDWF

SEQ ID NO: 6125 - protein, 187 aa, Methanobrevibacter ruminantium
MATTDNDINVRLIEKINQVEEKYNQNFSNTQKILMTTDGSITAILDVLYGKIALKTLEQHFEEATAESAKLVNVDVGDEVNFREIIMHKDEQPLIYAKSYIPLKRLSKEIKEDLVRADIPIGRILKKYHIESRREINIIDMEKANDKLIEIYNTDEDFLARDYTIIKDGEILMWIKEYFPISYFTEI

SEQ ID NO: 6126 - protein, 417 aa, Methanobrevibacter ruminantium
MNITEKILSQKAGHEVEPGEIIEIGVDLAMSHDGTSPPAIKTFEKITDKVWDNEKIVIVFDHNIPANTIGSAEFQKVARNFIKTQGIKSHYIHGEGICHQVLPEKGHVEPGMVIVGADSHTCTYGAFGAFSTGMGATDLAMVYATGKTWFMVPEALKIEVEGSLRPGITSKDLILNIIGEIGIAGATYNTAEFCGETIDNLDVESRMTMTNMAIEMGAKNGIMEPNKATIEYVCNRTGKSKDQLNIIKSDKDSNYLKEYLFNVDDMEAQIACPNDVDNVNPLSKVEGTHIDQGFIGSCTNGRLNDLAQAAAVLEGKQVHDDVRLIIIPASKEIYQKAMDLGYIKTFLDAGAIVSNPGCGPCLGGHMGVLSEGETSISSTNRNFKGRMGDPNSSVYLANAGVVAASAVSGFIQNPDSL

SEQ ID NO: 6127 - protein, 392 aa, Methanobrevibacter ruminantium
MQYYISPFNKEEEYKFPKNITIYDTTLRDGEQTPGVCFSKEDKLEIARKLDQFRIHQIEAGFPIVSSREADAVKAIANEGLDAQIICLARTKRADIDKALDCDVDGIITFMGTSDIHLEHKMHIKRQEALNICMKSIEYAKDHGLFVAFSAEDATRTDLDFLKRTYSKAESYGADRVHIADTVGAITPQGITFLIKELRKVTNVDIAMHCHNDFGLAVINSIYGLLAGGSAVSTTVNGIGERAGNASLEELVMSLKILYGKDLGFKTKYIQELSELVAEKTKLGIPYNKPVVGKNVFRHESGIHVDAVIEEPLTYEPYLPELVGQKRQLVLGKHSGCRAVKAKLDECGFKVTNDQLCQIVKKVKESREEGKYIDDNVFKDIVRSIDANYVDL

SEQ ID NO: 6128 - protein, 181 aa, Methanobrevibacter ruminantium
MIEVEVKAKINNFEDIKVKLNEINAIKTKTEKQIDRYFNSPVNDFAKTDEALRIRETKTEKSHNLFITYKGPKIDSKSKTREEVEMKIEDSDKCAKIFENLGFIEVRTVKKNREYFKLENFEISLDDVEGLDPYMEIEIALEDGSDYNEAQDKIFDLFEQLGITDGFERTSYLELLEEQDK

SEQ ID NO: 6129 - protein, 181 aa, Methanobrevibacter ruminantium
MTDVDIKIENIVASASIGKDIVLTEVAKALEGVDFNREQFPGLVFKLQDPKTAALIFSSGKLVCTGAKSIDDSKLAIKKTVDLMRTIDTEIPHEFDIKIQNIVASANLQSTLNLEAVALELENTEYEPEQFPGLVYRLSDPKVVLLLFGSGKVVCTGAKTKQDARLGVENAKARLSELDLI

SEQ ID NO: 6130 - protein, 687 aa, Methanobrevibacter ruminantium
MIKLVVFDLDNVIIDGEGIDEIGKLVNIEDQIAKITEQAMQGEIDFETSIKKRVGLLKGASTDDIKTLANEMPLMEGAEETVSSLKENGFDVAIISGSFDIIADIIKEKLNVDNVFTNSLVEEDGILTGEVTGPLVSGSKVDVLSKFIEDKGYSLEECVAVGDGANDISMIESAGYGIAFNAKPALKENADIIVETRNLTDVRDVIINLNSENTEEGADVDKEVEIETEVVESTDVVVENQEEQVADATEEVVEVEEAEEAVEEAVETEEEAVEEETVEAEEEAVEEEAEEAVEAEEEAEEIEEAAEEEAEEATEEEAIEEAEEEADEEVVEEAEEEVAEEEAEEIEEAVEEEAEEEVAEEAADEEVVEEAAEEEAEEATEEEAAEEEAKEEKPKKSKKSKNTLPEPDFELADTIEGVRAQKDEREAKIAQVADEREAFNREAKEQRKIRDELNTELKLNLAKAIEFRDQRNEINREVEENKRARNKVNEEIKNLEWSSGKKDRIRIENEIKKIDKIIETRVLDIKKENQLVKTANDLRKQLAEITEDNKVKEEAEKLKKQSEEYHAKVVELSEQAQEAHEQMLSYFRKTDEIRTAADEAHKLFIQARKNASAKHEEFKVILSEIHVINKRLGSNRARRRKSEKTSNAPGKRNREEKEKAEAIFDKFKNGKKLSTEELLLLQKYDIN

SEQ ID NO: 6131 - protein, 81 aa, Methanobrevibacter ruminantium
MDDIMDLENKKDDKNQNKEEIIESSEKEVKMEICYTCGKEFDMNSDEGAHYHYGEYPMCGYCTNFFGFYKEDMMGGKAKKE

SEQ ID NO: 6132 - protein, 741 aa, Methanobrevibacter ruminantium
MHEVIISEKPKSAEKIAKALSPNAQKKKYNRKINYWEFEENGKKTTVLSAVGHLYSLTSASSRDRLGFDLTWVPAYEVEKQKYTRDYINAIKKLSKGADKFVHACDYDVEGTLIGYNALKYACGNNAEAKASRMKFSTLTKKDIVEAYNTMRDIDIRQVDHGIARHMLDYYYGMNISSALMKAVRASSSRFISLSAGRVQTPTLSILVDREKEIQSFVPEPYWMIKAKSDYDIIADHVEGKIFDEERAKKIYADCQGADADVTSVKVTESIRKPPIPFNLGGLQSEAHTVFGFSPKRTQVAAQNLYVGGYTSYPRTSSQKLPESLDFKNIFAGLAKDPEFKKHIFDLPAKLKPNEGKKTDAAHPAIHPTGVLPSNLSADEAKIYSLIVYRFISVFSENSKLETMKVNLKVADEKFTFSRKRVSYEGWLKHYPFKKQENDAFPPINKGDQLKIHKILVEEKETKPPARYNEASLIKELEKRELGTKATRADIVAKLYDRKYIEGKKIEVKPLGINIIDTLNEYCKDLTSEELTREFERELEGIDTDKYTKEQILENGEKEVKTILAEINQNKKQIGEKLYGAYQETNVVGECSCGGKLIKRYSPRTKNTFVGCSNFPKCKVTYSLPKGANMLKKTCPTCGLPMISIKKASGKGRDHVCLDSNCGKDVSRRQAPEVVGKCPECGKDLLKRSGRYGEFVGCSGFPRCRFTCSVDELNNLGKDKNKEDVKENKGVSKKIVRSEAK

SEQ ID NO: 6133 - protein, 364 aa, Methanobrevibacter ruminantium
MTIEEKIKAIEEEIQKTPYNKATSHHIGKLKAKISKLKEEQIKRSSGGTKGEGFHIKKSGDATAVLVGFPSVGKSTLLNEITNAESKVGAYQFTTLEIIPGVMEYNNAQIQIFDIPGIITGAAGGKGRGKEILSVARTADLIIVVLDVLNPQHINVILKELRNVGVRPNETKPDVRIKKTRKGGVNVSSTVPLTYLDEKTIRSIINEYGIHNADVLFRDDVTIDQFIDVIEANKSYVPMMVLLNKVDLVDEHYLNEIKKELPPFIPISADKQLNIEALKEEIFNNLNLIRVYLKPQGRKADMEDPLVVKKGSTVIDVCGKLHREFVKNFRHAKIWGTSVKFPGQKVGPDHVVEDEDILRIILKK

SEQ ID NO: 6134 - protein, 200 aa, Methanobrevibacter ruminantium
MSISDKIEENKVIFISGTPCTGKTTIATKLNDFLTNNGFNSYFIKINDFAIENDLVLGKDPDKLYTVIDIGRLDEVLNKEINNFLDENSSDDSKIVVVEGHLSHLCNGADKMIILRLNPEKLLKRLEERKYSENKIHENLEAEALAVCSAEAYDLYDDKASEIDTTNKSVDETLELVLKIITGELESPVGSVDFMDWFLL

SEQ ID NO: 6135 - protein, 123 aa, Methanobrevibacter ruminantium
MARGKRPKWMIDIAQERMDILFNRAEKEYKKNPERSHRYIELARNISKKYNTKIPQPWNRRYCKKCYKFLVPGHNCAVRLINNEINIYCGECGHVMKIPYIREKKLKRRAKIDSYTFKKRDYE

SEQ ID NO: 6136 - protein, 71 aa, Methanobrevibacter ruminantium
MTINIGKAGVNDNVIEEIKRQLKSNPIIKLRFAKNVARNKDDLINSIVEGTKSQLIDVRGNVAVIYKKQSH

SEQ ID NO: 6137 - protein, 146 aa, Methanobrevibacter ruminantium
MTTVFDVPAELLINTVADEFKDNNDKIVAPEWTKLVKTGVHKERKPENIDWWYVRCASILRRVYIDGPVGVRSLRTFYGGKKDRGVNPEKFRKGSGSIVRVALHQLEDAGYVEKVDAGRIITPQGRSFLDNTSAELIKDIPELSKY

SEQ ID NO: 6138 - protein, 123 aa, Methanobrevibacter ruminantium
MSELDELRKKRMAELQRQAAMNADPQMAQQQMAQQQMAQQQLAQQQEMEAQLKQAMRQILTPEARGRLDNLRLTKPELVQNIEIQLLQSAQAGSLRGKVTDEQLKVLLKNLMGQKREIHITRR

SEQ ID NO: 6139 - protein, 193 aa, Methanobrevibacter ruminantium
MKACVLYSGGKDSSLMGYILNQLGFDVELVTANFGVYDSYIPASKSAESIGLKHRVLNLDISILEKAVDMILEDGFPNEGIKYLHEAVVEEVANHYDLVADGTRRDDKTPKLNRNQIRSLEDRKDVQYMNLDSFGYKTIKYLVGNLFELKHEKSNKDTSSDYEVEIRLLIDQKGGNSSEIFPEHYQTNVVGLK

SEQ ID NO: 6140 - protein, 51 aa, Methanobrevibacter ruminantium
MSRNKPLAKKLRMAKANKQNRRIPIWAYGKTQRKLRYRPKPRHWRRNDLKV

SEQ ID NO: 6141 - protein, 86 aa, Methanobrevibacter ruminantium
MAEELERTYVIPLRKVKNVKRTIRAPRAIREVQNFLMKHMKAEEVKIDASINEFIWERGIQKIPSKVKVIAVKDEEGIVRATLAEN

SEQ ID NO: 6142 - protein, 225 aa, Methanobrevibacter ruminantium
MLKRINLTGNPNLGVYISVNDEIAIVPFNVPVEMESVIKETLEVDIIKTSIAGSNLNGVLATGNSNGFLVSPFTYDREIELLESAGINVAKLPGKYTAIGNIIAVNDYGALAGPNIGEETIKVIEDTLKVPVKIYPFADTKIVGSASIVTNKGALLHRDTISEEIDFIEDFFKVEANIGTVCKGMPLVGACGIANSQGVMVGESTTGPEMARIEESLGFLDFGNF

SEQ ID NO: 6143 - protein, 74 aa, Methanobrevibacter ruminantium
MITKNYRVKGSFVMGSETQVFTKELRAIKEEDIYEKLYSIFGSKHRIKRNQIKIDSIEEISDDEVEDPIVQAIL

SEQ ID NO: 6144 - protein, 145 aa, Methanobrevibacter ruminantium
MEDQQKLQQILSQLEVYKQQSELYKTQIDAVQASLAEIKILESTLDDISGKDTIETLVPLGAGSFINAEIKNEDKVIMSLGSGVAVSKTFAEAKETTAAQKKELEETLDKLFADLQQITDIVAQLSPQAEQLMAKAQAQMGQPLY

SEQ ID NO: 6145 - protein, 576 aa, Methanobrevibacter ruminantium
MAGINLFSSLKKKFADASSKLRNKVEEEAKDEDNIELIEESKDEFDDIDEDLIEYIDEEDEDDDWDFDDIDKEDKSKEEPKEESKEESKEESKEESVEETVDEAIEEVEDVSADEDSDEEVKDSDEEKKDSEEKDSKDKKEKSGFFSFLKRGKKEDKKEDEEEIEDSKEEEVPEEEVKEASDEEVPEEETSEEESEEEVPEEEIEESEAEPVEETVEEEAEESEAEPVEEAVEEEAEETEEAKEETSEEDEEEKPKKKRSLFRRGKKDKEKDSEEEFDAEEAKGKGGFLSFIREKTISEDDVEDILFELELGLLESDVAMDVSSVVVDSVKNDLVGQKIKRSSDIEEYTYEALKKAVYNIINIEGKSMTELLEEKVAQGEPLVVMLVGINGTGKTTTIGKLANFYIKKGYTPVIAASDTFRAGAIEQVAYHADKLGVKLIKHEKGSDPAAVAFDAVQHAKAKGKELVLIDTAGRMQTNTNLMDEMKKIRRVSKPDLVVFVGDALTGNDATEQARKFNEAIDIDGVILTKADADSKGGAALSVGYIIQKPILFLGMGQSYDDIKEYDPDWMLEQIFS

SEQ ID NO: 6146 - protein, 882 aa, Methanobrevibacter ruminantium
MDDETNNNQWNSSTSFILVMVGSIIALAGIWRFSYLIYENGGGSFLIPYILAIVIMVIPLLVLEFGVGFKYKASLPRIFYNIKSEFEIVAWFILFLIFIVLICYTCIMSWDLIYIVLSLFKGWGNNPSVFFTTTLLHSTSNPYGLTYLVVPIGIGLILIWALIYFISRREINRGISLVTKFSLALTFVLVIILSVFALQLPGSRTGLMALFNPNWEYLLDYNIWLTAFGQLIFSYGLAYGIASTYSSYLPEDSKLIDSAWVIVLISLIFEILMSVLIFALLGHMALGKNMPITSLVSDSFSLIFVVFPNVFNVMGSWATIIGPLFFMVIFIGGLGALFALIEPLANAICEKFIWTKDRAIKTLVLAGLFASFIFATGMGEYFLRIVDGFITQFAIILVVLVEILVFGWLFDLDDIRNVLNNNSRIKLGKYWVYLIKFAIPILLIVIWILGVYNLIITGDRQSLLVQSILASIIVIVPLALTVAPFNGEYSLGSITGGYNYFRDSGDDEEAKSNSKPDLKSRFTSRFTSKDNDVDNGTEGYEEKTYVEKTIDDYEGYDGVVAITDDEEENSSLKSRFSWDKFKKSKNGKNVLNNVDLSAKEFDPPSDDDYDDYETYNSLDDGYSQGSDDFDNSMDDYRSKSKSKSKSKSKSKSKSKSKSESKSLFEKINLFNKDQGENDYLDDNYGYNSNDNYEDDDSSFEDVFDDFDYITPIREEEPKSKPKTKSKPKSKTNSKSKSKAKGGNKKPKFISAEDLDGIESLDDLSSQPNKKPASKKTSASKKKSSSKSKKESGSKSKKASEPKEEPKPKEEEIEYEEFSDDFFDDGVFGEEGYEALLDDYVEPKPKSKKKKASSKSDQSTPRDSKPYYDYEKKGSDSVFNLDD

SEQ ID NO: 6147 - protein, 243 aa, Methanobrevibacter ruminantium
MIKNHLILYFFISYLFLVHFFTYLTISIPIIFYHFHFLSLFVHDFSINLHIYPYFQNIKFIKDKNIPIIIKIGDYMDKKMTVLLVALFCLLCVGSYLIFEPARHISYHEVNLTDTCVAKVPVTDKVSSYTDNLNIHYYSDYENDLNITSFYDVAPESSSQGHLRMDNLKKEVLGTEKGSAGNLTYYKNNNAGTYTMYVEDRMSHNYILLSAKDLTIFTNVYSSLEARIVVNETDIDSLDSSYA

SEQ ID NO: 6148 - protein, 578 aa, Methanobrevibacter ruminantium
MNTAEILVNLLERDGNEFIFGHPGEQILPFYKALKDSSISHILTRHEQAAAHAADAYARVSGEYGICISTAGPGAMNLVMGASTAFKDSVPMLVITGDNDYDKKDSDIFQSFPINSVFENISIKSFHPYDGKSAVYNMIEALILLHKFPKGPVHINLSRDVLLEEIDFDSIDLRDIGLSNIPSLNLNDSDIIENFDLFDDSLDNLYDFSQKLSADVDITIQSAIKKLKDSSKPLVILGNGIVWSKATFKLSDFLSKTMLPVVTTYHSKGIVSDHDRLNLGIVGLRGNSLSNYAYENSDCILVLGAKLSERTIGASDFDIAKEKMIHVNIDENCLKGKINICMDVNEFLDCLLDELDQDNGTFDYDDGWIDEIYSNYEELIVGGIEEVEENFNPLRPPYAINRIIDAFKGAYFLSDAGTHTTWTTLLAKSDSFGKLLFSGGFGPMGYSLPGSIGVAFALKKRGIDERVLVICGDGDIQMVIQELATIREYDLNIDIFIINNSQLGIIRQWEETVYDFDKYQVDLINPDFAKLADAYGVDSMKVESKEDLQLAIEMSLDSNKAFLADVCVCEENIPMPKK

SEQ ID NO: 6149 - protein, 115 aa, Methanobrevibacter ruminantium
MDGLEIINSFNKETIYEFSEAFTIFEDEIYFIFKVDIISINANPSKTKDKNKNKNKENKDNKKAQRIISHLEIEPIAYLLKKAENEDYQIEAIDEKYTEFIGKNKDKLLKEFLNQ

SEQ ID NO: 6150 - protein, 171 aa, Methanobrevibacter ruminantium
MIDEEPIKTTVEELRKLIHISNYIGDAIETEDKLLIPVSKAAVGFGIGEQKADNSLAGTGAGVSVEPITMVVVSKGNSGVDEIRTINLSKGNQTNKTLNEIGLILTDVLKEFLPSKGNDDYIDVDDVSEVDIQDADIKEKVEDAVEESDLKEKVEEEVEEAEESLGIEIDD

SEQ ID NO: 6151 - protein, 388 aa, Methanobrevibacter ruminantium
MNEILLMLPGPTTADPRVLQAMSKAVVNHRGDEFGEIYTETTKLMSKTFQTKNDSYILTGSGTSAMEAAVSNLVNRGDKILNVVGGKFGERFADISKMHGIESVQLDVEWGTAVTPDLVEEALEKDEDIKAITMVHNETSTGVAAPIKEVGEVMKNHDALFIVDTVSSLGGDYVDVDKYHIDACVTGSQKCLAAPPGLAAITFNDDAWAACEKVEDNNYYLNMPKYRANGNKDPAQTPYTPSVSLIYALKAALEVLHEEGLENRIERHHTAAAASRDAVKALGLELFPDEAVSSATVTAVKMPEGANDDQIRGTMLNKYKVQLAGGQDHLKGNIFRIGHMGVINYQELAITFTALGLTLKGLGLVEDAGAGVAALANHYIKFKLLEKV

SEQ ID NO: 6152 - protein, 366 aa, Methanobrevibacter ruminantium
MSFRTKRVIISTLLVMIYEFFLMKYLFLLFGGLDDIYLLLLTILFGILNMVPMFFEEKKSRPITRLLDTISGFWIWMSLFYLFVILIIYIGGVYIDWPFYIIVILVLLVPLLTVYSYFHAHKIIIHERTIQMDNINEDINIAHLSDVHFGSTRHDKIIRDLSDKLKELSDYCDLAIISGDIVDGSSAIEEDDFLPLKDVNMPIVFTPGNHDSYLDIEDVFGACRNAGIIVLDDEGMEFGNLNIFGMTFIFGMTRKFEEFEVVSTGVLGDFVKEDKVNIIIFHVPKNWEDFSKLGFDIQLSGHTHGGQFHPLTWICDLIWYNRGLFKANIGGKDRYLHVTTGVGSMDYPFRWGTDSEIVVLKLRKND

SEQ ID NO: 6153 - protein, 421 aa, Methanobrevibacter ruminantium
MLKRTVKKNGDELFPLGLGAMRLPTKNNSIDKDLAREFILYAIDNGINYIDTAYAYHGGESESFLGDILSLTDSDGVKYRDKVKLSTKSPSWMVRSREDFDAFLNEQLRRLKTDCIDYYYLHTIDLSILERLKGLGVYEFLEKARSEGKIKNIGFSYHGAPNEFNDLIDDYDWDMVLVQYNYLDVNAQAGIRGIRYAYENDVAVFIMEPLKGGILAGELPKEVDGLFKGVDSNKSSVDWALSWVLNQKEVTCVLSGMGSIEQIKENMNIAERVEVDSLSDDELAVLEKAQGIFNSMMKINCTGCGYCLPCPKGVNIPDCFNIYNEKYLFNKKAFGPIPGAMVNYYMVVGGITNKQSNAGLCNHCGRCKRLCPQSLDIPSHLDSVKSEFEKFGFNYQIKFIRNIAMPSINKISKVFDVFKHS

SEQ ID NO: 6154 - protein, 1435 aa, Methanobrevibacter ruminantium
MYISEIEINQNIILNTEGNKIYLNNSPKSNIHDNWFGNTLLNYDEVPYEGCTNWIFLNGESNQVSLENPISFEITFTLSSFNKNTKKISNYDDRKLPFNLTAHAEHGILNPNSNLLGKTTIYETEIINVERIIGNIANIDSEFEIMEFLVTDGTTFYDLNQLINNNSNNEINISGNYTYHDDIDFEFKEGINVNRSLIINGNGFTINGLNSSRIFNINGDNVTINNISLINGNGYEDTYDSDGGAIYWKGADGTLIQSNFTNNSGYNGGAILWEGDNGRIINNTFKNNSAFDGGGAITITVERGIIINNTFTNNSASYDGGAIYLIASSGEIINNTFTNNSGYKGGGMICYADNLSMINNTMESNIASDDNGGAILWEGEIGRIINNTFKNNYASEEGGAISIRGEIGEIINNTFTNNNASYRGGAISIIITSGEIINNTFTNNSGYSGGGILCYGNNVSIINNTMESNIASYDGGALYVSMDYAMIINNTIKNNNASDNGGAIYWDRYKGIISLNTIANNNANHGGAIYYEGYSSNLNYNIILNNKNSEIYFDNVRTFNGSNNWFGNNASNYNLNPNTSFEYDNSPNVTLSDWLFLNGTANPKIVNAFESSQILFKLYSYDGILISEYDNSLITDTKLNLSAERGRFDKTSASFNEPINYTAIEGGRDTIRGAIDKSGYSINLTNRRVSSKIAMDTKEINYSRNASIKLNYNDFAGGNVTIRLMGENNEYLFENMTLNKTIFLGVINRDSYNVRIEYSGDRSFLEENISESLIVNKAGTKIVPTNDTIDLGIGENSKVNYTFYVIDDEGQYITNPEDIGNISFKSDGSAVEVDSKTGEINTIKEGTANILIRFQGDENHLDSNASVYVISSNKIRTKITAENLTTDYKKDDYIIARLTDLTGKPIANAKLIVELNGTNNYTTNSKGEIKVPTKGLDSNEYIAKIIYEGDESYRFSNASVRLIVNKLNTEITANNITTIYNITKELVIRLKDVNGDPVSGVELTVDLNGMNNYTTDDNGQAIVEIKGLIPNNYTAKITFEGNGNYNKASTESDIEILKIPSILNGTDMTVNYKEDKYLTVSLKDKDNKPIHNASISVELEGIKNYTTNSDGQIKVPTSSLPAKNHTAMIRFEGNEIYEKSNATAKITVNKISGKLTASNVTARYGDNQNLVISLKDSKKNPLSGFKVSVDLNGKKNYTTDSSGQIKVSTKDLVPDTYKAIIVFAGNENYTGSNASASVRINRINTTFKYTNMNTIAFDSNIEGRIGEYFRFQLLDEDGKPLSGKQVFIGFNGVKYNRTTNETGEARLQINLKYVNHYTFAIAFLGDDYYKGSFNVALINVTEQIPVLSTSAKTYKSSAKTKTLTATLKSSRGHVLAGKKISFTLNGKVYTANTNSKGLASVKVSLSKKGTYSFTVQFGGDSTYKKVTKSSKLTIK

SEQ ID NO: 6155 - protein, 1391 aa, Methanobrevibacter ruminantium
MKLKRYSYIIMIFLVCMISISAISAADDSSIATDDSNKIINDNNNQDIVLEENGPSTNIALEDKNYKIEKPQLKENSPGNFTDLNYLINEDETTRHNTTITLDRDYIGGEKGIRIDRPLIIDGQGHTLNASQNNRVFHITSENVTLKNIIFTGGRSDYGGAIYWQGDNGKIINCNFTYNTATKYGGAVFWGDDEFEGTADQTIAKDGIIINSNFISNKANVGNGEAWENGGGGEGGAVYWYANNGTICNSYFHNNRAGGQGGAITWKGNDGIICNNTNFTANSAGDSGGAVFWRGDNGTISNNCEFNNNIAYGRTSDGISRGGGAIFCHGENGKISNCSFMENSAKPESESGKGGGAIYAEYNTFITDCIFIRNSADYYGGAILIFRTGDVYRNIFINNTALNGNTITLKGIGHSTITNNIILNKTNAIYWNESDYTIEANWFGNNATQYSEPYEYSQTWLFLNATANPNPAPFNIPTEVKFKLWLYNKKTKKITEYDNSLLPTIQLSLSQTKGSINKETAGLDDPINYTANEVGTGSITGKMEWITDSIFFEIVNDPKLEVSVNPSEIDYGDNITLHLGYEDEATGTVNISFKGSTHEKTIENIPLNKTITITESILPDEYTVTVFYSGDNQFSRASKTADEKLKINQKNPNMTVTSYEIYVNDTNGVMFSIKLDKDATGKIILTGDIGREINLTEGSIKDGKRIIEIKNNGFDLGKYNVTFSYPGDEIYWEYETTALSEIKVIETKIIPQKEEIVLIIGDKSKINYTINPSNAVGDVTFTSNDTNVVKVNGSGDIEAIDKGQATITIKFSGSKDYAPSNATVNITIGREMAKLTAENITVTYNAEGYLKVALKDSKNKSISGAILIVDLINKTNYTTDSNGEIKVPTKSLAAGNYTASIEFEGNDKYLPANTTAGVTIEKDNPRLTSNNITNKYHTEDYLIVSLKDSASGPISGAELTVYLNGSETYKTDGNGQIKIPTKDLLPNIYVANISFAGNENYTEANASASINITKLDTRLNATDTITKYNVNKDMIVTLKDIDGNAISGLNILVDLDGVKNYTTDSNGEVKVPTKSLAAGNYTANIAFEGDNIYIGSNATAKVTIEKESTEISATNVSAKYGSNQSMIVTLKDSQGNPISGAKVSVEIDGKKDYTTDSNGQVNVPSKNIVPDTYNATITFAGNENYTSSNTSASVVIKRVKTALNYTDMNTTAFDSNIEGRVGEYFSFQLLDEYGKPLSGKQVFIGFNGVKYNRTTNETGEARLQINLKYANNYTFAIAFLGDENYSGSFNFAIISVSEQTPSLSTSPKTYKASAKTKALTATLKSYKGTAIPDKKITFTVNGKTYSANTNSKGIATVNVSLNKKGTYNFTVQYAGDSTYKKISKSEKLTIK

SEQ ID NO: 6156 - protein, 262 aa, Methanobrevibacter ruminantium
MKNILISNDDGVMGPGILASKQALEGLANVVVVAPQENNSAVGRKVNIMKHMYLENYELADGSMAYGLSGTPADSVNVGINYVCDEVPDLVVTGINPGINISRLQITTSGTVCAAIEAVGLGIPAIACSLFLDDDCFKQDDEGNWYVDTDYSFAQKILAKLVKKVLDEGMPDGVDLFNLNIPSKPLSDKIKITRLADSMLKFNILERVDDDGNDTVMNVPELIEDYEEGTDGYCLLVERRPSLTPLNVHFGAEISNLEDWEF

SEQ ID NO: 6157 - protein, 244 aa, Methanobrevibacter ruminantium
MDINEWEEWYEEILNTFGFRREDDEKTADLLDEILADHGFLTIDEFYDEIMLKKGYTDKFIVFGAGPSLKEHIRFLKENYDLSKYMLVSADGATTALLEEDVVPDIVATDLDGKMSDLLTANSLGSYFVIHAHGNNEELIDLWTTSFNKILGTTQSVPVGNLYNFGGFTDGDRAMFFVVELGAKEMVLAGMDFGTVVTKYSRPNIEGETGPADEIKTKKLIFAERLLNWIRENEDVEVINLIDS

SEQ ID NO: 6158 - protein, 208 aa, Methanobrevibacter ruminantium
MKEIEFDLKNNPFYNFLSSRYSMSARLNVEKMWNYSKENDLSFFTLSLAALINSLNEIPEMRRRIVNGKVIEYDYLDAVCPIMDEDSGIYKEMRVKAPQRFDEILDWHDYVQEHERKILNGTEDAFEVKTTERDELNIANFSCIPWVDFDSITNCTASSNQIQPLITWGKVNEDYEMTVAITVSHIFVNGRELAYFYQFAQDNFNNLF

SEQ ID NO: 6159 - protein, 372 aa, Methanobrevibacter ruminantium
MAIEDILMFDETIFNDINAFNPDYMPPNYNFRDSQMEGMAMAIRPAIRGGRPTNSVILGSCATGKTTAIKKVFELVEKTTDKVVCVYINCQLHTTRFGIFSQIHKKIFGHQPPETGVPFSRVYEKVMDKLSSDGKSLIVAFDDVNYLFQTPHANKVFYDILRAYEEYEGVRTGIFAILSDLEFRFALDKNVNTVFIPQDIVFPPYNYSEIFSILKDRAKAGFFPGVVSDEIIEEIANQTYEVGDLRVGIDLLRVSGNIAESNASRTIELEHVEEAVAKQGSVNLMETINSLNDLEKTMIKVLIDRDEVVTAGALSKEFKEQAGVSYATFNRTLEKLEFLRLVDTRYTGKGVRGNSREIILRFSPEDIKRCNL

SEQ ID NO: 6160 - protein, 63 aa, Methanobrevibacter ruminantium
MMVSHNNRTCDLRKKQNLRDPLTFNNLRINIKDCMVIFVVFTVLLLSILAVSAAPSPDFMLWV

SEQ ID NO: 6161 - protein, 157 aa, Methanobrevibacter ruminantium
MILIHCGAIMSENNQREKKFEYFEVTADIGFYAYGNTLEEAYENAALAMFNVVTDIDKVKTSETREFEVESEDLVSLLYDYLDEFLFLQDTEFLFFSEFKVDIDKTEDGYKLNCIASGEEINWDVHVPRSEVKAITFHKMCVKKEDGVFKLRAILDL

SEQ ID NO: 6162 - protein, 482 aa, Methanobrevibacter ruminantium
MSIRESLVKVRENVWELPSDYKKEMRVPGRMYLDDEAVKTIEEGALEQVSNVACMPGIQGASIAMPDIHFGYGFSIGGVGAFNYNNGVVSPGGVGFDINCGVRMLRTNLTEDEIKPHLKELTEVLFKNIPSGVGSKGQIRLKDNEINEVLDYGAWWAVERGFGWEEDLKFLEENGRMEEAESEVVSKKAKKRGVPQLGSLGSGNHFLEVQKIEEVYDDNVAKAFGLEPGNVTIMIHSGSRGCGHQICSDYLRKMDKAYRNYKIKLPDRQLACAPIDSPEATGYLKAMAAGANYAWANRQMMSHWVRQSFEEVFKRDAEDMGMSTIYDVAHNIAKKEVHKVKNSHMEVLVHRKGATRAFCPGRREIPKEYRDVGQPVLIPGTMGTASYILHGTDVAMEETFGSTAHGAGRVLSRTAAKKQYTAKDIEKELNDKGIHVKANSAPVLAEEAPGAYKNVDSVVKTSHDAGIAKLVAKVVPLAVTKG

SEQ ID NO: 6163 - protein, 257 aa, Methanobrevibacter ruminantium
MIAIIGGSGVDEITDMAESIEKKIVDTEYGSVQVSLFEIEGKEVVFLPRHSEGHTCPPHKINFKANIMALKELGVSQILATNAVGSVDLEIGPGSIVIPDDFLDFTVNRDRTFYDDDVVHIDMSEPYCNRLRNALLENSDCVNGGLVDGGTHICTEGPRFETPSEIRMFKMIGGTVVGMTTLPEAVLAREKEMCYASIAIVSNYCTSIAKHKLGVEEIIEIMAVKKEELISLLFNTIKNLPVDYDCECHHALGDAEF

SEQ ID NO: 6164 - protein, 130 aa, Methanobrevibacter ruminantium
MNEFGQLQLIWIRRLARETGRITALIEAGNLSVIDLVRYKKSISSMDGFCRFVIESQDWDDVRRIPEIVEDVEEKLFLHFYEMIDRFDGEGAHLDFSKEDEGKICLNFDDASLEDIVFTIIDDEDIDVFL

SEQ ID NO: 6165 - protein, 67 aa, Methanobrevibacter ruminantium
MRNNLKIYRAIENITQKELADELGVSRQTIVLIENNKNDPSLELAFKIAHKFDVKIEDIFINDSNKK

SEQ ID NO: 6166 - protein, 99 aa, Methanobrevibacter ruminantium
MENLLNLKYTCKDCDFTWITLNGEHSICPKCHSENIDLLGEVKDLDIEAILAHNKMRGGCCGSARGKGPLTCGKPMPDHANPNIPHHNHNKKTCCGYNE

SEQ ID NO: 6167 - protein, 355 aa, Methanobrevibacter ruminantium
MNVSDLKRDHYMLKGPLAKQGYDWWWHSLTAYNKETGEPRPFFIEYFVCNPALAEDEPTLGQDPKNIEAGKKPSYCMLKVGAWGKEPKQIHNFYSMKDFECPDDKLDVKIGEFSLTEKHMTGYCKVTEEEARDHPEYMCDAGEMKWDLDIDKQITFNVGYGANTLFRKLNSFEMFWHAEGIKTQYSGTIELDGVEYEVIPEKSFGYADKNWGADFTSPWLWISSCNLTSLITGEKLNNSAFEAGGGKPKAFGISLPRKLLIGFYYEGKMYEYNFARFWNMVKVDFGFKEGEELNEWFINASNKDSKMEMKLYCKRDEMLLFNYEAPTGKKLHTRLWNGGNGFGEIKLMKKGRHID

SEQ ID NO: 6168 - protein, 735 aa, Methanobrevibacter ruminantium
MTDVELKIKVAETLSQNDVGKNIAKLDMESMFKLGLKDGDIIEIVGSKNTAAIAVASQSDMETIIRIDGTTRKNSGASIGEEVTIRRADVKEAKKIVLAPIDARIRIGGDFNRAFANQVMVQGDLINTGIKTPQRRVSGSGFFDDIFDDLMNVPGIGAMSQIKLAVVSTSPGGVVKVGPNTKLEINEEPVDISKLEGVSNLVDISYDDIGGLKEEVKKVREMIEIPLKKPELFEKLGISPPKGVLMHGPPGTGKTLLAKAVANESDAHFIVINGPEIMSKYVGGSEENLREFFEEAEENAPSIIFIDELDAIAPKREETNGEVERRTVAQLLTLMDGLNSRGQVVVIGATNRPDSLDGALRRPGRFDREIEIGVPDKDERKEIMEIHTRGMPLAEDVDLDQIANTTHGFVGADLEALAKEAAMRVVRRIIPDLGSDDEIPPEVLEKLVVTKEDFKSAQREIQPSALREVLVQVPNVTWDDVGGLDDAKQELKEAVEWPLKYPNKFKEFGVRPPKGTLLYGIPGTGKTMLAKAVANESEANFIAIKGPELLSKWVGESEKGVREVFRKARQTAPTVIFFDEIDSIASSRGGESGDSGVTKRVVNQLLTEIDGLEELEDVAIIAATNRPDIIDPGLMRPGRFDRHIKVDAPNEDARLAIFKVHTKDMPLAKDVKLKKLAKRAEGYVGADIEAVCREAAMLALRDDIEAKEVSAKFFDEAMDKVKPKSSNEEELIQYF

SEQ ID NO: 6169 - protein, 279 aa, Methanobrevibacter ruminantium
MDRHVIEALGRARITVENGKVVDVGEPMIEYCPLFDKHRGIKELTKEEIEKNIQFRIDDFGMCTKNRQLRLKDFLSFGISEILSTLLDENLIDCAVMVCEGCGTVLVTESEMAQGVGGRVSGLVETSPISQSFIWKSFGQDRVVDSETARIDQVDGLRLAIDNGYKNIAVTICLAEDGIILRELEKEYEDINVYIFAVHSTGLGREEAEIIFDTADVVTGCASKHLRDIGKELKVFSVGTSIPIFAASDKGEEFIKLRLDKIGGPKKKTGNSKQPNPLV

SEQ ID NO: 6170 - protein, 211 aa, Methanobrevibacter ruminantium
MSKDVVLILSGGLDSTTLLYKLLNEGNNVTALSFNYGQKAAIEIERASEICKMNDVNHFVFDIRNIVDLLSSSLTDKDNDNVQEPKSTVVPSRNTILLELATAFAISNNLEEVYYGAIKADTGDYPDTTPEFLKQINELNKVNNYEYIPVCAPFIDTDKKDVVKLALELGVPIEKTWSCYVNNDGTPCGECFSCKSRIEAIKEAKEELGIE

SEQ ID NO: 6171 - protein, 119 aa, Methanobrevibacter ruminantium
MLTLVSEHRIYGCHKLKDQGGKCTQWHGHQYRVILTLQAPYKDLDYRNMIMDTYDIEAIFNEFIGVDHLNLNEFMDSENPTMEEMSKFFYDGLKDKIECLVSVGVYETPETGVTYTPME

SEQ ID NO: 6172 - protein, 202 aa, Methanobrevibacter ruminantium
MIKIKVSEIFTSFQGEGPYIGTPATFLRLYGCNLNCPWCDTDISTYEILSVDEVFEILMTQMEFNNIRILVITGGEPTLQMEELKRLIKEIPDEIKIQIETNGSIFEYVPEIDYVISPKEDKETVFKNYYKYDNVFFKFVICSQEDIDEVIYLKDKYNYDKTIWLQGEFSKDGEMADLIRENFPHLENVKLSVQTHKYLNQR

SEQ ID NO: 6173 - protein, 140 aa, Methanobrevibacter ruminantium
MYKKIILPTDGSEYSNREILRATKLLAEDGEVIILSVATELRKTAFQRSKDIDRANKESIQEAKEYVAAMKKGFDDSVNVRTKVVVGFPAEAINQVAEEEGADLIIIASSGKRGLHRFVIGSVAEKVLKDSEIDVLLVHD

SEQ ID NO: 6174 - protein, 149 aa, Methanobrevibacter ruminantium
MKKESIFNDEVSLFNSIYVMHKAFEKFLKTHVNDLNINKAESKFLGEIYYNEGISQREIARNLFVSEANIAKTYKILEKKGFIYKKVDEKNNTRRQLYLTEKGKESFEEIIKLYEEYHHFILSDYTEEEIRKHEEMMKGIADKSLKFLK

SEQ ID NO: 6175 - protein, 424 aa, Methanobrevibacter ruminantium
MTQMTEAKKGNVTPEMQAVAEFERVDVGKILNGLASGRIVIPKNINRDTKACGIGQGLTTKINANIGSSSKIEDIDLEIKKAKLAVDFGADAIMDLSTGPKLLEFRERIMDSVDVAIGTVPIYEAGVVTLNKGNEIIDMDEDDIFNSIIHQAKDGVDFMTLHCGINQDLVYKLQEAKRMMGIVSRGGTFLASWILHNEKENPLYSNYDYLLEIALEYDITLSLGDGLRPGCQSDATDTSQIQELVTLGTLVKRAQEAGVQTMVEGPGHVPLNQIRANMEIQKTLCHGAPFYVLGPIVTDLAPGYDHITSAIGGAIAASSGADFLCYVTPAEHLSLPSLEDVKEGVIASKIAAQAADVALGLDTAWEKEVEMAQARKNFDWEKQFDLAFDSVKPRHYRNKCELDDDEMCAMCGEYCAVKIAKGDF

SEQ ID NO: 6176 - protein, 550 aa, Methanobrevibacter ruminantium
MKYEELVNVYEALGATTKRLEKTEILADFLKTVELEDLQKITLMALGRVFPPWSEEEQGIGDKLVMKAVGDAVGVSVAVVEDAIRDEGDIGAAAEKLYGKKTQMTFFSQPLTVNFVYNQLRKLAKITGNRSTAKKISNILELLSSASALEAKYICRTILEELRIGVGEGIIRDAISQAFGVDKALAERAHMLTNDLGLVAKVAKEEGEDGLKKLSLIPGRPVKPMLAQLSEGIEISINEMGCALCETKYDGIRMQVHKKDDEITIFTRRLENVTMALPEAVDLIREAFPDEDFIAEGEIIAIRDGKPTTFQNILQRVRRKHNIEEAMEKVPIKIYLYDLLYFKEPTIDEPIIKRREILESVVDCSNPNLALSSLVKVGPDNIDDAVDLFNKSIEGGHEGIMIKDCDEPYIPGIRGKKMLKLKAEPETLDAVVIGGVKGIGKRGDFIGSYVIALRDENDQLQPIAHVGTGLSDDDLANLTEKMEALKITEKGTRITVHPKIVFEIAYSEIVKSPEYSAGYSLRFPVVKRIRDDKGVDDIDTIERLESMFKG

SEQ ID NO: 6177 - protein, 70 aa, Methanobrevibacter ruminantium
MYEKDKLVLPNIIKEEFDCIELNEDTIFDWAIEDDKIILKPRNIVTTDDIIGIIDDDGGEWDIDNEIYSL

SEQ ID NO: 6178 - protein, 77 aa, Methanobrevibacter ruminantium
MGFLASSKIYGDYQIDIPKEVIEEFNVERDSIMEWIINEDGRISINFRKKYSIKDLVGAFHLDDEVSSVDLKRSLYE

SEQ ID NO: 6179 - protein, 454 aa, Methanobrevibacter ruminantium
MVEKRLFGTFGVRRNCEMMVLTPEFASRLAASYGSIVQGTVAIGGDTRTSTPMLKHAITAGLLSSGCDVVDLGILPTPAIQYAVRNYYDGGIIVTASHNPPKYNGLKFVDEFGIGTPDDMEIEVEKLYFDEEPIRASWDKIGEVFTNESIIKEYIAETLKRVDVEAIRARKLKVVVDCGSGAGSYTAPYILKELGCEVTTLNCQADGFFPGRDPEPIEPNLQDLIATVKNLGADIGLAHDGDADRTICIDEKGNFILGDKTFALVEKHMLKENGGGIVVTTVATSQAIYDIAEEFGGEVIATAVGDLLVARKLKDTDGLFGGEENGGLIFPDFIYGRDAAMTVAKILEILVKEDKPLSELVAELPVYYQEKLKIECPDDQKQDVMANIANEIKDTTDFELDTTDGVKILKEDGWVIIRPSGTEPIFRCFAESDSMDKAQEMANWGISLVEKYKN

SEQ ID NO: 6180 - protein, 267 aa, Methanobrevibacter ruminantium
MISDRQKTLLILILVLVLAFAIIFLGYSISLGNNQTAGVKLNDSNKIYINQSYPAEPIPDAKIDTSGVNSVLLGQNELGSVELLGPFGNSDSEIKIAYSIGMHPWESKVHKALFDTVLAKNSSLKYCYYIYKINVTNYNTDDEGRMDGQLLAQEFVAPHIINGDYDLFLDIHSNKGTVGGTYEQTNFAFAVGQDEKSEAFVKKILDKMPELVYYFPADQSSPPYITLPVEQAGTPTVNYETFSYEDINTTYDLIDKLVDVVDNLEFK

SEQ ID NO: 6181 - protein, 237 aa, Methanobrevibacter ruminantium
MCDLILNLIIKIDDIMIIKNYSNEPTDEAKVDSSLYDAQLIGENDLGTVHLHGPFGNEESDIKIAYLIGMHPLESKAHRALFDTVLDKDGDLNYSYYIYNINVIGELDEATEGRMDGQLLAQEFVAHHIIDRGYDFFLDIHSNRGSRSPGTYEISNFLFAPGFDEESSKYMNVLLSKIDELVYYAPEYRTSPEFITVPVQKSGIPTLVYETYSYEPIELTYELSEKLVDAVDSLDFD

SEQ ID NO: 6182 - protein, 378 aa, Methanobrevibacter ruminantium
MPIMSFGSQNINIITNKKAMTIRKLWKTPLKKGDRLHCYWNLASKEKKKIFEAEVTEVETITFKELKDNDELAREEGYEDSKEMVKEFKKMYPDRIADDDLFQIIYFEKLDINKWKGEKIDQKEMITQRADILFDTGKYDKSVLCYNAALKIDPNDVYLLNKKGDNLGRLDRFEESIECYDKALEIEGDNEYIWNNKAIAMLNSGNIEEALVASDGALNANPDNPVVLYWRGFILEILSEFDKALEVYDKLITIDDTNPEVWNARGNVLTDMDRLEEALQSYDKALELCLEDSEIDASAQNRKGNALLDLGRFEEAIQCYDRAIELEPLNTSFLLNKGVVLMEIDKFDEAEILFTKVLALDPSNDDARVLKLECLENM

SEQ ID NO: 6183 - protein, 240 aa, Methanobrevibacter ruminantium
MEYGATITSSIEYPKKMSFVIFLAKCPLSCPYCSNSELLYGGEEISLEEIIEKIDDSAFLSDAVVVSGGEPLVQLEDTIEILKYTRKIGLNTKLDTSGVYPNRLRKVLDLGLVDYLAMDVKAPFNKYKEVIHSDIGDKVKESLDIANEYDDVFLECRTTYCPALLEEEDLFKIVDEVECDLYTIQQFRNRCTLDESLDGAEEPNPHNMREIAQKIKELHPNQDINIKTAEFGQQKIELEN

SEQ ID NO: 6184 - protein, 374 aa, Methanobrevibacter ruminantium
MKARKAVEEIDPYVPGRSKEEIAQEFGVKKEDIIKLGSNENPWGPSPKALEAIKEELNNINRYPESDVELLKKEFARYSNVKPENIIIGGDGADEILDTLAKTFIEKGDEFIVPLPSYMYYEFLFKPYGAIPNYAKWNLETNTLDLDSVLDAINEKTKMLFLCSPNNPTGALITQDEFRPILEKTNKSRGGVCDAIVVIDEAYVEYAEGTNVNLLEEYDNIFIIRTMSKVMGLAGMRIGYGISSPEIIEYMHRIKPVFSLTKLSYVAALATIRDTEYIEESIKKGIESREYLYNEINKMKSVKVFKSYSNFMLIDIHNTGYTAAELTREFMKRGMIVRDCTSFKGIDEYYFRISICTLEEDKKFIEAMKDILNE

SEQ ID NO: 6185 - protein, 158 aa, Methanobrevibacter ruminantium
MKLKEPVKIFPGAQVIGDVEIDENCSIWHGAIIRGDVGPIRIGKNSNVQDNCVLHTSANLTLKIGDNVTVGHGAVVHGCEIGDNVLIGMNATILNGAKIGKNSIVGAGAVVSENKEFPENSLILGVPGKLIKETTQEQRDNIAWNAKHYVELANEYDE

SEQ ID NO: 6186 - protein, 439 aa, Methanobrevibacter ruminantium
MKALILSAGEGTRMRPLTLTKPKTMLPVAGKPIIQYNIEALRECGVKDILLIVGYKEEMVKNYFDDGSKFGVNISYATQTKLEGTANAISYGKDFIEDSLITLNGDIILDEEILREIIEDYEESGADTLMVLTEVEDPSAFGVVELDGEKITNIVEKPKKEEAPSNLVNTGIYIFNKDIFDKIDKTKVSPRGEYEITDSLSLQIEDGKFVKGHKTEKEWMDIGKPWELIEINESLLNNIKGEIKGTVEEGATLHGEVFLDEGSLIRSGVYIKGPVYIGKDCDIGPNSYIRGNSYFGDDVHIGNAVEIKNSIIMENTNVSHLSYVGDSILGSNCNIAAGTNIANLRFDNKTVKFNIKNKKVDTGRRKLGAIVGDGVKTGINSSLSPGVTIGTRATIGSGVLLYDDLPSDMRVLLKQEHIIQNKKENGQIRLEEVEEDMNK

SEQ ID NO: 6187 - protein, 53 aa, Methanobrevibacter ruminantium
MVKYVCMHCEYTWDSETGDETYKVPAGPIEDFPDDWVCPQCAAGIEGIITEED

SEQ ID NO: 6188 - protein, 448 aa, Methanobrevibacter ruminantium
MANKKLFGTSGIRGKIGSEVTSELALKIGKSLAKYLNNTGKVVIGYDTRTTNRMLEQAITAGLIEHGVDVIKIAMVPTPLVGYATIKLGADAGIMLTASHNPSEYNGIKLWNANGMAYTPEQEEKIEEIYYNEDFGKVEWDKIGIISHNDEIKKQYIDDLLDIVDIKPGLKVVIDCACGAGSELSPVLFRKAGCEVITLNSQVDGFFPGRNPEPNIANLSSLMKAVVATESDLGIAHDGDADRMITVDENGKVSDFDKLLALVSKKFGGTVVTTVDAGLCMDEAMEEVGGKVLRTKVGDVNVAEVMIEENASFGGEPSGTWLHQDFCMCPDGILSGLRMAEIVSKEGKLSELLAQFTDYPHMREKVICSKEQKIAVMENMEELLKNAFDDIKEINTIDGIRLSFEDGSWVLVRPSGTEDYVRVTLEAKTQEKAEFIRDTCVKIIKENI

SEQ ID NO: 6189 - protein, 412 aa, Methanobrevibacter ruminantium
MKGMILVMDGLGGRPLKELNNQTTLQAAKTPNMDKMAERGITGIMDSIAPGIIPGSDTAHLSLLGYDPYEVYTGRGPFEASGVGVDVIPGDIAFRCNFSTSDEDGIITDRRAGRIREGTKDIVDVLNTMVIEGYEDIEIIFKESTGHRAVLVLRGEGLSGEVSDADPKVEGNKPKEVKGLDGSPEADKTADILNKLVVKSYEMVKDHPVNLKRIEEGLPPANIIIPRGAGEVPEVEPINEKYEVNSACIAETGLIMGIGRFAGMDIIEMEDVTGGVDTNLYNIRDTIVDQVNNSEHDFFLVNIDGADEAGHDGNAKDKLEFIEKVDEIVMSELLKLEDIYIFLTADHSTPISVKNHSGDPVPIIINGPEVRVDDVKEYNEYAVAKGGMCRIRGADVMNILTDLMGYAHKFGA

SEQ ID NO: 6190 - protein, 192 aa, Methanobrevibacter ruminantium
MAKKQRRRVRDTWKEKSWYTIKTPIAFGEKEIGTTPARDPELVYGRTVEVTMRELTGDFSKQYIKLQFEVDNVAGDIASTKFTGHKTTTDYVRSMIRRGTSRIDAPVIVTTQDERKLKLHVLAVTTRRAKSSQQKYMRETITELVSNVASEKTFDELVEISVNGRLASEVYHKAKKIYPLKRVEIIKSKVLD

SEQ ID NO: 6191 - protein, 267 aa, Methanobrevibacter ruminantium
MCEIFGFSSSREEELNDYLKTFFSHCEEHPHGWGLAILDSDKYQIRKEPVKARSSVMLGNILLNPIVCKNMLAHIRLATIGNLDFYNCHPFVKKDNSDRRWTLIHNGTIFDCQDLCRYSTEEEGETDSERILLYIVDTINNYESVKGEPLSLKERFDIVSSLIKGMSCTNKLNLMVSDGEQIYVHTNLKDSLHYLKKDHSIFVSTQPLDDDDWKEVPLNKTFSIINGDVLFESDSHSNEYFETEEQLRFIEKFLESLKTDSDEEYAW

SEQ ID NO: 6192 - protein, 241 aa, Methanobrevibacter ruminantium
MCKDGISDEALREKLYQAFLEPTKKDKKEYIGIEIEMPIINLNKEAVDFKVVHKVTRDFSEEFDNFELEGIDYDGNIYALRDKASDDIICYGCSYNNIEFAMGKEENLFSVNERFLKYYSYFKDKFEEHGHTLTGMGINPYRKYNNEVPIPNERYLMLFHHLKSSSDYVGMEFHQYPAYGMFSSASQVQLDVPYDELVDNINVFSKLEPIKALLFSNSVFWKRMKTIFALEISYGNSVPMA

SEQ ID NO: 6193 - protein, 217 aa, Methanobrevibacter ruminantium
MYNQEFEDIDELLSYLESLNIYCVMRDGLYINFPSMGLKEFFSKDKITGEYYCKGEYKKREFEPSLDDIQYLRAFKFINLTFRGTIEYRSVCTQPIKDSMSVAAFHVGLKHKTDELNELFLKSGIYKNDCDANELRKLLIRREIPDFVDMEKIYGLALKVLDLAKEGLLERDLGEEVFLDSLYDNLNNRTNPGKRLLDSLDGGKSLEEIIKEYGEVE

SEQ ID NO: 6194 - protein, 474 aa, Methanobrevibacter ruminantium
MDKIFNLSQIKNNLSSEQLKEGSFGIEWECLRVKENGELSLSPHPEIFGDKLTNPYITTDFSESQIEIITPAFDTIDEAFSFFSFMSDLVNSSLSDDEYLWFQSLPCILPESDKIPIAKYKGRGLGEESMEYRKGLAKKYGLKKQLISGIHFNFSFKEELIESFYDGVIGDKEKISYKEFKDSLYLKISRNYIRYVWLIIYLTGCSVAVHNSFTLDCQKLMNHKDNQGSVYSDRGPSFRNSSCGYKNLEHLYPSYASVEEFTRDIQSFIDNGHLSEAKELYTQIRLKPRNPSDLLGSLNNNGIQYLEIRTLDINPFYKCGLIKNDMNFLHMFMIYLLIKEESDYESWQEDALYNEEKTAECGYEDGVKLIKDGKEVVLKDWALSILDEMEMMVESLNLENKSVIELMKLKIINSDLTYGRRLARLVEKDGYIESQLKLSRNNKLRSKYLVEETNLLNDERFKEYVPIALQGLSK

SEQ ID NO: 6195 - protein, 112 aa, Methanobrevibacter ruminantium
MRIAVATSNGEDVNLHFGKASSLYIYEYDEENDETSFIEHRTVEIEKDSKHQNPKIIKALADCEVAICEEFGFKASIFAEDAGLKLVKDEGTVEEVLKKYTDHVKFLKNVKI

SEQ ID NO: 6196 - protein, 523 aa, Methanobrevibacter ruminantium
MKMIKQTLGLNVEDKKYYLKLIIEAVLIGLFSGFIVSLYRLGLDHSESILSYILKYIQGDLTLIVLWFVILAIMGLITALLMKWDPDSLGSGIPQVMGEVKGYFDVTWWKTLIAKFIGGTLTALGGLSLGREGPSVQLGAMAAKGVSKYLPNSKTDEKRLLVCGSGAGLAATFSAPLAGFIFTLEEINKGFDRSIVLVGLVSAVVAVLVSNVFFGQSPIFPFTSLNLPLEYFWLLIVLGIAIGILGYIYNVGMIKAAEMWDKLSFLPLEIKFIIVFLVTGIVGLFLPEVLGGGYSMMHLIELSLPPLSVLIVLLIGKYLLLIFCFGSSAPGGIFYPVLVIGAYIGAIFSAIVIPIFGLNPLIAYKFIMISMAAMFASSVRTPITAVVLIAEMTGVTNSIVAMIVVVILAYIIPTILDNDPIYETLLMRLLKKNKGIDFDKTKSVLEEYVVPMDCALIGTKIWELPIPKSAMVVSVVRSGNTLIPDENLELKYADELFIIMNQNTYPEDNNKIESLIYNNWKEE

SEQ ID NO: 6197 - protein, 435 aa, Methanobrevibacter ruminantium
MKIGIIGGTRGLGRTLAWYLKDFDFDVTVTGRDSIVGAQVSEEIGVKYSNNNKKIVQDSDIVIISVPISSTESVIEELAPFMKDGSVMLDVTSVKEGPSKKMKECLSEGVEFIPTHPVFGPRTTDLKGQIIVLTPIKKGKWYPRIYKFLEDKGMRIIETTAEHHDDMMGIVQVLTHFSYISTASAIERLQVDLKDTQNYESPIYNLMIDTIARIVSQNPYLTYSIQHENKKGEKIRQALFDSMSELKDALSKEDEEEFVEIALKATKHMGDIQGALGRSDKAINALTQEYNILLQSIGEEVGLKHIYSDTIHVGKIKKIDLDFLYLEDENGKVKKLKMSNVAILSEKELFEWKINNQKTYSRDISAMFTKNSNPHIIKDTLKLMEDIIDVEIIDIYDGEPVKEDQISYTFKIEALSMEAIKNCRDILIGFGGISR

SEQ ID NO: 6198 - protein, 353 aa, Methanobrevibacter ruminantium
MKVTSEDESKGTVELFPETLDDLWHLSHIVAEGDIVYSKTTRRIQDTSGDLIRGDRGVKKTFTLGISVKNVSFHLFTGKLRIIGSIVSGPEEFVPLGSHHTIEAKLHTPITIKKERWSSYALKRIERAIEASKKLSAIIVVIEDDVADFGLMRQFGIEYYGPIMGNVSGKRIIDKNRKKNIEKFYEKIVDYINKFDNIQTIVLAGPGFFKNDFFKYLELKHKDLAKNTIIESTGSGGRVGINEVLKKGTVEKLATENRVAYEISAVDAILKEIAMNSPLVVYGKKQVHEAINMGAIEKLLVLDNLVRSENMEDSMDMVENMSGEVLVISSQHEGGKQLEALGGMAANLRYAIS

SEQ ID NO: 6199 - protein, 318 aa, Methanobrevibacter ruminantium
MFFELLIVFLLCFFGTGIVSIVFRFLGKRGYMGNLYETVRGGTPRAVGIVPFILISLFMPSGFNNLVLVMGLCALIDDIIGRKTIANLPIEIGQLARGIGMLCVIGLGYPIMGVSSILVVLLIQPMNIADMQPGTAAATTIIMSFFTLLAVVIMQVGPVLEIHPYYYPLLVLVTCLAYCPLDFAGKIMMGEVGNHTFAISLGICFYALGGFIGTLILFIVTTGLIAYLRRYNLSRFLINKLHIPNPTFGDLFMDVLTGGGLGDLFRKILLKSNQYDVDNEILIALGFRRLLYNPYSPNLEKVVQKDSRTKRADLRRFY

SEQ ID NO: 6200 - protein, 181 aa, Methanobrevibacter ruminantium
MADVFDVIKNRRGVRAYKDEQIDDEDIEKILQAAIMAPTARGEAPWHFTVVQNKELLDEINDSVHSILTNSGDELLEAIAASGRNVMHNAPTVVFVSAKSDATNMQADCSAAIENMLLAAEGLDIGSCWLGLVALFFSVEENLKKLHIPEGYTPLYGVSLGYKVEENEPNPRSDVLVNWLK

SEQ ID NO: 6201 - protein, 457 aa, Methanobrevibacter ruminantium
MKETKKIKNIVIGAGPAGRLASFELGKLGEETLLIEKKYIAGTCLNEGCMVVCALTDISRFWKNCQRFSEMGLVNGLLELNYNSICENIKKTQKFLRKLNQEENESVSNKVLYGEASVEVDEDEKIIVTVKLDNDNELQKEEYKGKETLSFEAENLLIATGARPFIPNIPGAEYALTSSDVINLDEVPPKLNIVGGGIIATELSNIFSSFGSEVKIIARSEILKDLEPEIKSYVVKKIINDVEIHENTNVLKINEDSIETDNGEFEGKTLIATGRVPNSEILKGLVDLNEDGSIKVNEFFQTSKPHIYAAGDVTGGITLTPYARKEGISAARNMAGYLNKFEEMIVPQSLTLDLDVSFTQKTDKEADPDKIEDVIIPGLGGPHAFWRILRGETGLTKISLNTETDEIVRASQISPSSIDDTAYLAFLMNLGIKKEAFDDFLEVHPSTDAYYKILKIM

SEQ ID NO: 6202 - protein, 88 aa, Methanobrevibacter ruminantium
MCIAAPAKIVEIDTESNICAADFGGVRQNAKLDLLPDAEIGDYVLIHAGYAIEKLSEEAAKESLESWNELMEMLDEEDRERELQMNGL

SEQ ID NO: 6203 - protein, 164 aa, Methanobrevibacter ruminantium
MCEEIKLLKDLGCPEWVIEHSKGVSRKAVQIASNFDDVDIELVRVGGLLHDIGRSKTNSIEHAVIGAKIVSDLGYSQEIVNIVERHIGTGLTEEDAKELGLPIKDYTPQTLEEKIVSHADNLFNGADEVDVDFTINKWKRKLGENHPSIEKIKEIHEELVGRFE

SEQ ID NO: 6204 - protein, 302 aa, Methanobrevibacter ruminantium
MKVICTVDESLYRPEVVRWRERMAMMEPLGEVVVALPCSMKKPYSNSQSHQKFKRATKGYQEVIVTSPFGICPREMENTFPIQSYDVTVSGDWSFDEVRISGELLRDYVGDKPVIANVHGGYEEVCREYLDNCVYVCQDGRPTSPDSIYHLREELKKYSKVKHRDKVLNELRSIAKYQFGPEAYKIISDDVVAKGRYHRTIYSEGKQLALLNRDIGLYTLNLEGGRRLAELDIHVVEIDFDLKTNSVFAPGISNADLSIVPKDEVVVVRDGEVVGVGKAVLTGKEMIESTSGIGVKIRHRKK

SEQ ID NO: 6205 - protein, 95 aa, Methanobrevibacter ruminantium
MSEELALAVKDAVSVVNDPHMGVSIVDMGIVQSIAIEGSTAELVIKPTNPGCMSVTRIAAQAKAEALKVEGIDKVKIIIEGHVMADSLNEMLNRD

SEQ ID NO: 6206 - protein, 167 aa, Methanobrevibacter ruminantium
MWESLNSKFSKYPARMTVAQKMFELGLRIGEDNKIYCGNLKISDSALAAAANVDRRVIKSTVNVIVQDEDLFEVFSNIVPAGTLLKNIAKNLGLGVVEIEAGEESEGILAAVATTMSEHDIDIRQAYAGDTKFEGNPVLTIITENPIPGELLNEFIKINGVLKVSVL

SEQ ID NO: 6207 - protein, 357 aa, Methanobrevibacter ruminantium
MLSDPIIQKNFPGTFEFEEAMVIIDCLKEWPKSRLCDDKAIARKAAKTIDIDIKTVRDVLALLEVNNCAYNIKINELCIKLIKHYRSGKLTHKKIAKKLKIDDNIVDQFIEENESLLEETKKTYSQETLMALNDSFNDFIKGRKPLKINKDEEEDNPDEDSKDEKATDEEFKSGEVEIKEEVEETKEEEEVEEEKPAKKRTVNQKFWYLTFDEVIDCLKNGYATDEEISEKIGCKLNIVRKILYSLYDMHLASYKRDKDKETQWYTYDWKFNESEYKKLELNIASAELKKLNEDLEYEANNMFFICPVGHYRLDFEDASTVEFICPECGAELEFDDNSEVVEALKDQIAYIEEMISE

SEQ ID NO: 6208 - protein, 300 aa, Methanobrevibacter ruminantium
MTDNPNYKEAETEQGQVYKYVEIRGYQVIPIETHYIKPNESIDFMIDDISKLCKSGDYLVIAETPISVSQGRLVDEADYTPSLKAKFLATYWSKYFWGYVLGPILGIKERTIKNLRKLPEESKRHKEVVLQLYGWKHALKPASEAGIDLSNAPGTCVSLLPENPEKVAKEISESLMEKTNQDVTTLIIDTDATYRRKNKYFTGLPIAIDGIEADKGVFGYALGQLSENMGSTPLGCSREISVEEGIKIANIAEDYQKSLSTAMETIYSAKDVLNSDTPEVTVESLDSIIHTPAVLVRKIE

SEQ ID NO: 6209 - protein, 189 aa, Methanobrevibacter ruminantium
MEKSITYFENPGAENTDAVIELVRERLEGSNIKYVAVASSTGASALKLNEALKDLDVTIVNCSHHVGFREPNKAQISAETKTELEEKGIVTFIGSHALSGVGKSISKKFGGVTPVEIIAAVYRTFSQGIKVCAEISIMLADAGLVPVGEEIIAIGGTGSGLDTAAVLTPANMTNVFDMKFHEIIAMPRP

SEQ ID NO: 6210 - protein, 389 aa, Methanobrevibacter ruminantium
MKFIDDAIKESEESIEKTASPKKSDDELDKELLDIISRSRAKIIVVGAGGAGNNTISRLTEIGIEGAETITVNTDAQDLFYSQADKKLLLGRQTCGGLGAGGEPAIGEESAEESEEDIRAELEGADMVFVTCGLGGGTGTGSAPVIAKVAKKAGALTVAVATMPFSAEGVKRRENAEIGLEKLQENADTVIVIPNDKLLEVAPNLPLNKAFMASDEILGRAVKGITELITKPGLISLDFADISSIMKGSGMAMIGMGESESGDRAIESVHEALSSPLLDIDISNAKGALINISGSSDLTLQEAEKIVQIVADRLDPEANIIWGAQIDEELQNMIRTTIVVSGVKSQYNSSSSGSDDGEFTDIDDFTDADILGEDTAPNDPLDEFLDGIF

SEQ ID NO: 6211 - protein, 163 aa, Methanobrevibacter ruminantium
MEDDKNSIFALKTSAGQERTVARLLGMKADKPGVDIKAIVVPESLKGYIIVESATNLDMKNPDMKVRHLRGIVGAKRDGTIDPSSQITLEEVKKFLKPQPIISSIQKGSIVELVSGPFKGEKSKVVRLDESREEVVLELIEAAVPIPVTVKADQIRIIKKEAD

SEQ ID NO: 6212 - protein, 160 aa, Methanobrevibacter ruminantium
MAKDTVEVLLEGGTATPGPPLGPAIGPFGVNMMQVVEEINEKSADFAGMKVPVIITIDSNTKEFEIEIGTPPTTALIMDELGIEKGAHEPGAEVAADLSVEQALKIARMKFDSLLSNDYKSATKEIMGTCVSMGITVDGKDPRDAQKAVDAGEYDDILVE

SEQ ID NO: 6213 - protein, 212 aa, Methanobrevibacter ruminantium
MTQEIIDAVKEAKEQAKPRNFTQSIDVIINIKDLDVRKPENRFSEEVALPHGRGKPVKIGVIADGELALGAKNAGVDVVISKEDLQEFGKDIKAAKKVVNSVDSFIAQADMMPLVGRFLGRILGPRNKMPKPVPASAKIEPLLERQQATIKVGVKQQPSIQILVGTQDMDDEKLAENIEAVLAVLDRNLEKGRNQIKSMYIKATMGSVVRVI

SEQ ID NO: 6214 - protein, 335 aa, Methanobrevibacter ruminantium
MAHVAEWKKEEVNELKGIIDSAEVVGIVNLLNIPARQLQEMRKTLSGKATIRLSKINLMKLALEDCVNEKANITELSDYMEGQPALVCTDMNPFRLYKILEDSKTSAPAKAGAIAPEDIVVPAGDTGFPPGPFLGDLQQIGVPAKIDKGKIVVQKDTTVVEAGEPVPKAVAAALTRMDIKPMEVGMDLKAVYEDGSIFKADVLAIDEEETFADIQNAFTRAFNLSVFSAFPTSETISTIISTAHTKAYNVAIEAAIPTGKTSDMLIALANAKMLALAGELASDAIDDEIANKLANVAVAAAPVVEEAEEEVEEEEEEEEDKSEETAALGLGALFG

SEQ ID NO: 6215 - protein, 103 aa, Methanobrevibacter ruminantium
MEYIYAAMILHTTEQDINEENVTKILEAAGANVDDSRVKALIAALEDVDIEEAMETTAMAAAPAAAAPVAEAAVEEEEEEEEEEEDEEQAAAAATAGLGALFG

SEQ ID NO: 6216 - protein, 201 aa, Methanobrevibacter ruminantium
METKNLIIICATVILAVVIVLSAFIYVNMGNETHISSNIADTLQNGDEIVVKLVDKDNKPLVNKTISLNFKDENGKGNAVSYDLLTNDKGEVYYNVNLTEGKYVFSADYAGETFIGSSSLNKSVEVKKDVKTANLSSTDTTKTAKTKTYTDWQEDYETGRYDEDGNPIYRSIMSTSGGQYEPGIYECYWSANGPISERRIG

SEQ ID NO: 6217 - protein, 910 aa, Methanobrevibacter ruminantium
MLKIFEDLGYKKQICKTCGQEFYSQVDRDTCGDAPCDEYGFIGNPATDKPYDLYGIQETFRTFLEKEGHEPISRYPILAKRWRDDVFLVGASIFCFQPWVTSGLVEPPANPLEVEQPSIRLNDVDNVGRTGRHMTCFTMGSHTVINKPDNFIYWEDETIRLCHEFFKSIGINTEELTFIKSWWKGGGNEGPCYEVCCRGVELATLVFMQYKTLENGDKEEIPIKVVDTGYGLERIAWISQGTPTAYDACFAPVVDKLKEITNVSVNEEILARNAEIAGMMDIEDIGDIRDLRQQVADSLNISLEEYLENAEPMEAIYIIADHTRCLAFMLADGIIPSNVKEGYLARLVLRRTIRFMKELEMEESLSDIMAIQLDFLREFYPEIAESQEHIMNIINLEEERYAKTIEKGKKTVKRTIKRLKKEGKTSMPLETLIDLYDAQGMPPETVEELASGDKDFEVFVPDNFFTIVADMHEEDKVAKKETFELDVPETELDFYKDIYQKESDGTIIEVVEKDGNLNIILDRTIFYPEGGGQPSDIGIISIEGTIYEVVYAEKLDGVVLHRIATKEDEDVASLVEDLRKYIGTEVHMAINWNRRITLARHHTGTHLVIAAARKILGQHIWQAGAQKGLARSRIDLAHYKRITIGELDEIEKLANEYVMMNIDLDINWLSRDDAEKKYGLILYQGGVVPGSQIRVVKIPGIDVQACAGTHLSRTGEVGPIKINKTERVQDGVERIDFSAGLAAIDSIQNDKAIIKESSDVFSVTNDQLPKTCERFFNEWKAQKNEIARLQKEIANLKVSTLAENAFEVNGLKVLKEILDANIKELQKIATDFTDNDKVDLVFIGNNEGKIVGSASKNAIDSGVQVNNIIKEAASLLGGGGGGRPTLAQGAGPNADKMADALDLAVELLNK

SEQ ID NO: 6218 - protein, 815 aa, Methanobrevibacter ruminantium
MIKKITILSVILILFLAVSTVAAIDVDTNDNLDDGSSSNSDLISSSSLDSSSSDDVSSGSSEVSSSDESLDGNNLSDGNVSSSDESVGADNLSDGNVSSSDESVGADNLSDDESSSDALSEELPKTETVIKADPINYNYASVKGLTINLTDSAGLALSNKTLTVKVSALNKTSNLTTNSKGQAIFKLSASVGSYDVFISFTGDESYAPSNASSKITIKKSSTKIKLSNIHGYLTISNYVSVTLLDSAGKPIKSKSVTIQVNKAKYNVKTDSKGIAKVKVANKIGTYSVNAKFSGDKNYYASSNSSKLTITKMKVYIKAPSVKYYMTNSSAPYLTINLTNVKGSPLAKKKVSVKIGKKTYTLKTNSQGIAKFKFTKKVSSYNCKINFKATSNFYGASVNSKMTIQKMPTSLKAPSVSINSTNYGKVLISLKDGKGKALKNTTVTVNVTELKKVFTLKTNASGVATFSFNGEKTFNLKIKYAGNKNYAASSVSSKINVKQIKVKLSDVIGASRVLIDYVNRTKDLPSNVQYNNYNFTVTQLTYLASKAVKNINNKNYGDIVLISVPKSYKSSGEIYDTVYKKDFVKIANSVVGSSYNYKNKEYVSYSIYKVPFKVYSISFAKVLNFYGNNKKLPNYSLFTLADFAKVKDNGGYNFYLTTDNIAGKKSDLNMLKSLAKTLKSMGYNAVIVGIGPDIHNVAYRYGCTGNNSVLLACFGGVDVGCIEEWAGDLGDLNGHSFVNSYQGAHVLGLWFTKPYGASVSLNKKVGIAWDADYGFPLNTPAKYMKSHNISYIETGTVANACKLLSEGKMGGPQLIS

SEQ ID NO: 6219 - protein, 386 aa, Methanobrevibacter ruminantium
MRYFMNYDLIIARYGEVALKSNRVRRRFESRLVNNIKASIDAEVKVNQARIYIFPKEFDDAIEKLERIFGIVSYSPAISTKSTFEDIEKTVGEYAEHLYEEGLLDENTKFAISCRRVGQHEFSSQEMAAFAGAVVVRKYSCPVDLSNPELTIYLEVRDGDAYVYHEKIEGPGGLPLGTQGKVVSLVSSGIDSPVATYLMMKRGCQVIALYCDNEPYTSPEALQNFNDLIDQLNLYASGAPIKRRVVKYGEYLSTCKAEAPDKMTCVLCKSGMYKLAGKLAKKLNAEAVIDGSSLGQVASQTLPNILATREDLDVPVLSPLIGLDKLEITRIAEKIGTFEISKRDDGGCKAVPRYPETNADLEFVKQVKEEMNQDEELEKAFKTIVY

SEQ ID NO: 6220 - protein, 366 aa, Methanobrevibacter ruminantium
MKTTVSVIKADIGSVSGHCVSHPALMEKCDEVLANALETGILEDYYITRCGDDIDLIMTHRNGELNEEVHKTAYDAFIQATEIARDLKLYGAGQDLLSDTFSGNVKGMGPGCAEMEFKERRSDPVIVYCMDKTEPGAFNLPIFKIFADPFNTAGLVIDPSLHDGFSFEVFDVMEHKKVVLDCPEEMYDLLALIGSTGRYVIKRVFKKNGEIAAAVSTDKLNMLAGEYVGKDDPVAIVRAQSGFPANGECVEPFAFPHMVSGWMRGSHNGPMMPTSQEEANPIRFDGPPRVVGLGFQVTDAKLVGPVDLFDDPAFDETRRQSANIATYIRRHGPFEPHRLPSEEMEYTSLPGVMEKLEPRFEDMDDD

SEQ ID NO: 6221 - protein, 170 aa, Methanobrevibacter ruminantium
MILKTARLILRPWKEEDAECLYHFAKNPKIGPIAGWPPHKSVEESLEIIKTIFAKKETYAITINDKAIGCVGLLFYPDTNHKWENEGVELGYWIGEEYWGQGLVVEACNELIRHAFEDIDINKIYASFKYENHQSKRVLEKLGFKYYCDLKNKDYTGEEFYEIAMFLEKK

SEQ ID NO: 6222 - protein, 63 aa, Methanobrevibacter ruminantium
MADVDVTEIRIILEDLSKDQLTEILEKNGYTSKGSEKFLIKEIMTKISHDIIIDELDQLGVLD

SEQ ID NO: 6223 - protein, 80 aa, Methanobrevibacter ruminantium
MKDLESEEKIAIDIAKLERNLNQVEDIKFEGKEKEVYDRAIDYWNDSKYYLEKKDTRTAFGCIEYSHGLLDALRMIHGLI

SEQ ID NO: 6224 - protein, 221 aa, Methanobrevibacter ruminantium
MKIFKMNPENPDMDLIDEAIDIMAQGGVILYPTDTVYGLGANIFNNQAVQRIYKIKHRERSKPLSVLVSDIESLELIAHLDDHSREVVNKWLPGPFTFILNKQKTVSPYVSSSTKVGVRIPDNKIARELASIFPITTTSANIANEETLSNPHDILKQIGDCIDLAIDVGDLTGGKPSTVIDLTSAKPSLVRKGLISNDLESIKEDIGDMDSNKNDIDDMNL

SEQ ID NO: 6225 - protein, 231 aa, Methanobrevibacter ruminantium
MKILSTMQDYEKISTNSPLDELLDGGIDKRTITQIYGPPGVGKTNVSLNIAVNVARSGKKVIYIDTEGGISVERIKQISGEDFDNVAKNIVVFEPTSFKEQEEDLELIEDWLASNNSEVELIVLDSAVALFRVEDDKSRSHLLGKQMQQLAKFAVDYDLAVLVTNQIYASFEEDSDEMAPVGGTIIQYRSKIIIELKREEGSSERIAILKRHKTRREGLAIHFSITNNGIE

SEQ ID NO: 6226 - protein, 386 aa, Methanobrevibacter ruminantium
MIQKKKYAKAAKIIPEGYKSANQFFESVFQDKEMIWMGQNTNELHIGHNEEVHKAMIDCIESDEYCKYPPPEGFTELQSLILKDLDLEDLSIYINAGATESLYLAMNAVLSDTDNVITPDPGYLIIDNFASRFAGEVRAVKIYSEENNYKLTPKLVRENMDENTRVILLIDPLNPLGSSYTEEEIKEFAEIAKENDLFLLHDITYRDFAQKHTLAAKYAPDNTITCYSFSKIFGMAGLRLGAIVSTQEVIDVVKSIIINDVGTSMVAQAGAIAALKTKPQWIDRVKDTTFENQKIIKEAVDQCEGVFLPVYPSSGNMMGIDLSGAGIDSEDMSQYLIDRKVFTRQGSYTSNTFGHKYLRVSYSIDPEKVKVFAREFVLAVEALRTK

SEQ ID NO: 6227 - protein, 591 aa, Methanobrevibacter ruminantium
MSRISILDKDKCQPKKCNTVCMHYCPGVRMDEDTIVIDEKTKKPLISEELCSGCGICTNRCPFGAISVINLPEALDDPIHRYGQNSFELFGLPSLKEGTVLGLLGQNGIGKSTIMRILSGELIPNLGNYEEEATWDKVIEYYKGSSLQNYFKALQAGEIKTIHKPQMVDQLSKVVQGNVKTLLSNVDERGKLDEIIDDLDLKNVLERDMQNLSGGELQRVAIAATVLREGDFYYFDEPTSWLDVRQRLNAVKVIRSLAEAGKSVLVIEHDLATLDALSDNVHLLYGEPGGYGVVSGNKGVRVGINAYINGFLQEENVRIRKQAIEFSIRPPTPEDDGEVLSEYSDLKKEYDGFTLEAEAGKIYHDEIVTAFGSNGIGKTTFAKILAGVEKPSEGNILEKVEIAYKPQYIESDFDGTAQDFLFANAPTYGSNIFNSEIGKPLALENLLDKKVKKLSGGELQRLALAVTLSQDADTYLFDEPTAFLDVEQRLIAARVIRKIVESRNAASLIIDHDIVFIDYISDRAMVFSGEPGLNGKASKPADLRTSMNQFLGDLDITFRRDKETKRPRVNKYDSYLDREQKEQGEYYYLKE

SEQ ID NO: 6228 - protein, 112 aa, Methanobrevibacter ruminantium
MKQVMVVRTDIKMGKGKIAAQCCHAAIGAYKQADKEKIRKWENEAYAKVVLKAPTLQDLYNLREIARANGVAYYLVTDAGRTQLPKSTVTVLGLGPDEDDVLDKITGDLKLL

SEQ ID NO: 6229 - protein, 271 aa, Methanobrevibacter ruminantium
MNKIKKHESKFTNNRLLNPAEYMPKEEVETLKQVSYLIVLFLLFIFFIYSFWPMANMKFFSFLEIVLMVYIALNIDYSNWKNKVLFFFLVPYGSIAWFLFEELTNSLFDIFHMIILLYFMKVYYEKFREYTETNGLGITILLLFTIIFISFILTMIVEGVSPIDSIAMVSNAFTSNGYAVLGSSFGGKLNSILLVWSGYILSGVGTATMTVALLSKHFNKRIKENEKTNEAQYAELKEMIERNNEEIKEILKENNLEKKTEEELEKKIIEP

SEQ ID NO: 6230 - protein, 304 aa, Methanobrevibacter ruminantium
MSNKKSFLAKIEEIILMQTKPDYMDSYEKVNDLIKERLNAQEKPPKSALFKSTYLNGTQIFHYGNSQSKNLIVYIHGGAFINEIGFQHHFFCSYISKKLDAYVISPVYPLAPKHSCNETFNQITDLYKSLIEENKSNGDNKNNNYNNSNNNKSIYLMGDSAGGGFVLSFCQYLKTVNLPQPDKIVVYSPWVDISMDDSPYDNESDPILGEIGLREIGKSWAGELDTKDYRVSPLFGDNSGLAPILIFAGDNEIFYKDILKYYEKLKEDNVDARLVVGSGMFHIYPLFPSPEASEAFKELKKEFE

SEQ ID NO: 6231 - protein, 99 aa, Methanobrevibacter ruminantium
MELIKNYNEKELTIETGNKIDTTTAPDFENEIMDEMGNFDSLTLDLKNLEYISSAGLRVLILVQKKLKADDIPFVIINTNDNIKNILTMSGFDKILNIQ

SEQ ID NO: 6232 - protein, 210 aa, Methanobrevibacter ruminantium
MIKLAYCNVEELDLKRAYSLVSKSRQEKIDFYRFDKDKKLSAGAYLLLKRLLSEVNIKDFEIIIEKYEKPRIVDHENIYFNISHSSKMVLCAISDKELGVDIENIDGEIDLNIAKNFFYNDEYKSIMNCDNPSDEFFKYWVLKESYMKYTGLGMNLKLDSFEIVIGDEIKLKDDDSDLKFNLFEIEDYKIGIASHYNVYDLIEYDLKELY

SEQ ID NO: 6233 - protein, 624 aa, Methanobrevibacter ruminantium
MKTKLKQILISFIVTTIFYFALSQTFITQLGLGSPQIGLLYVFGLLFGPFGALGASLSNVAIDVYHGYTFVQILPSAIISFGVSLLAYKLWYSGFKSDEYTKPRLDTIYHLCLFLASIIICGMIYSVGHGNLAYILISPDIEESIIIPSFLNFTNVAFIMGIAGIWLFKRTNLIETPKKSERRLNKNLYRLIFSLLMVMTIVSFIFIIRNSDNLTIITGLIIVVALMYAYMTKPFIHEIQEVNENSIIAKIVRNFIIITLILGFFGGLVSIASFDYVETSITLNIYLHLMPILVISDIIIILFFIPGIIILKYIGDNVVKPITSFSEIEGFIKEDEKIEAEGLIKVYSEYVNEQNEIGTLARSYTELINHNNNYIENIQKIEGEKERTNAELDIATNIQAAALPTEAIKTDAFIVNGYSKPAKEVGGDFFDYYELDDGNLAIVIGDASGKGVPAALVAMITQVVIKQTLINNHDPSEVLFSLNNQLCVNNPESMFITLWLGIYNKTNKKLTFSNAGHNPPLIKENGKFKYLDIESGIVLGIMEDFQYEDEEITIDGELVTYTDGITDANNNDGEMYGEDRLLEFFNKFKSDKDPILPLLKDINDFTKDTEQFDDMTLLYLKVND

SEQ ID NO: 6234 - protein, 125 aa, Methanobrevibacter ruminantium
MNSMNFKVEIDELHRLNEFILNELPHEDFMVNLIVEEIFVNIVNYSQTEYIIVNLDYKEPNLTIEFVDNGIEFNPLSKEDYEAPDSIEDAKIGGLGIHLTKEIADELDYHYEDGENHLMIVKKVE

SEQ ID NO: 6235 - protein, 105 aa, Methanobrevibacter ruminantium
MSSSKEYLEYILEQLSELDEITYRAMMGEYIIYYRGKIIGGVYDDRFLVKPVKSAREMMPNANMELPYEGAKEMILVDDVEDKEFLRELVEAMYEELPAPRKRRK

SEQ ID NO: 6236 - protein, 156 aa, Methanobrevibacter ruminantium
MDILAKLLNDKLAFAEISYTIEEAKSISDSNKIPIMICSEILKENEPFAHSWDVTSDSIAAYIASLLDAKLLIATDVNGIYTKDPSLSGAELIKEIDVNELLTFEESSIDLMLPSLLIEYGLDCYVVNGEYPKRVLSIINNEDCSFEYTFIRNGND

SEQ ID NO: 6237 - protein, 53 aa, Methanobrevibacter ruminantium
MEKVNCQSCKQEIPLIEPYVQFNCPECGRPIARCESCRTFGHSYKCECGFEGP

SEQ ID NO: 6238 - protein, 89 aa, Methanobrevibacter ruminantium
MGEVVNTLKVMPESPEVDLEALKVAITDAMPEDAELHEITEEPIAFGLVALNVVFIVEDGEGGTGPTEDAINAIEDVASAEITDSRRLM

SEQ ID NO: 6239 - protein, 504 aa, Methanobrevibacter ruminantium
MAKTIIPKYKVSKFEFTEEERRTLEELRENLIDLAISERMSNFNEDLILNDIIRFLDNRLFSNADYVRNIDFEKLDSFNPSKYKHIGNPKRYSQFYAIFKDEIEKYKNNLARNMFQELIGYGEIGFLIDDDDLEEIMVIGLNKPVFVYHREYGMMETDLIFKEEEKILSIIDSIARETNRRIDQQSPILDTRLPNGSRVNATIPPLSADGPTITIRKFKKDPLTIVDLIRYNTLNTEIASFLWLCVDGLGVKPANIIVSGGTSSGKTTLLNALSIFINPKERIVTIEDTLELQIPHKHILRMEARTVNIENQGEITIEDLVKNSLRQRPDRIIVGEVRGKEAITLFTALNTGHSGFGTLHANSSRETITRLTNAPMSVPKIMISSIDFIIMEKRIYKSDGLSYRRITEIAEVVGIEEGTIQLSKLFEWDSKKDEFKNLTILSKTLENIASLKGVHISILNEEWKNRKKVLDYLVRNDISSQDDISKVLEDYYINPDYVLNMISN

SEQ ID NO: 6240 - protein, 183 aa, Methanobrevibacter ruminantium
MVIFIFDKFFIQLSDSIINFLVSISNLFLSFFDKNNDSKEKWGNETNQFDSSKYEELNYFNNFKSVNLNYSDNSNSGDDLKNENYSFISNLNLSKIFNNENIFEYLENKYLNKQAMFITPNGTNENESNKNFLYNLKIKLVVLILDNRFFQIRSSQDLLKLLFYVLFNYNKSFFHSYCCICFF

SEQ ID NO: 6241 - protein, 201 aa, Methanobrevibacter ruminantium
MFFILFALFILYLPKIRHENDYSSISKELPYALRQLSTELRAGKSLFDALDSIVDSDYGVLSREFSRVLEEIKYGETSENAFLNLEKRVNSKALSRVIYEILASLRIGSNLSHSLNIIAEDVNFDMRMKLKEYSEKLNAFIMIYTFLAILAPVIILTMLLAASVVIGDIVPSSLLFILYGLFFPMIIVFLAFAIKKLEPKL

SEQ ID NO: 6242 - protein, 502 aa, Methanobrevibacter ruminantium
MYELIKESINSDESALELAKSKKDVISVVDAISDLSFEDTMKLGTRFKKFPIGCDLTEVVVGTCASDLEKMDLFGNCMLANMIGAPIHICAYAFSDIAEKYGQRGVEIMEEVYNITDVPLDLDHFGKYGAMRFPKHIVGCGGDCYNQGPSFTECPRGRIHERLLDKEKAELDDKETWVQLSSSVAINLSSEQCNDGHAAPLEEAQDLADLAKKYGKGLEAIMFVGDGYDELITGFTKAIEMGVDVFVIEGGPFNRCENTNESFAKTIAMSRVLCPGKVVATNGAYESECRAGLRSGLNVIITGFPKNHHGYMCGFEPGTARRGKFGLPRVIKIMNEEISAGPTRVPVQREELLALTHAVKLAGPENIYPKTIGSFAIGDAHWATIQNSKMYKEMYLPKTLEEIADSVNGNSVSLHGGRFVSWLVAKELDKKGIDEIIITDSNPWVEKVSVDNLQEELNATIIRGHADDKGAGMIAKESIVTTTIPKIHNAIKSKIPHAVNII

SEQ ID NO: 6243 - protein, 333 aa, Methanobrevibacter ruminantium
MIESILEKAKNREKLSRNELIQLFEIDDEETLKELCKIACDIRNECSDVIKLTSTIHLTNKCQVQPRCKYCGFAAKTSSIGYYDAFYKSDEEIRQAAMCVERSGIPRISCSGGHGYKGKQAVNAAKIVKGETSLEILVNVGADLTQEAVDELKKYDADTVCCNLETTNEDVFNFVKPGEKLSDRINICRMVSDAGIGLSSGLLIGIGESYEDRVDHLLFLGSFESLEEIPIMGFNPYVDTPMENHPPCSIEEQLKTIAITRIMYPRIRITVPTPTIGPENVELPLMAGANNLATVIPEDYPLVVKGVGNPEYGNLHEVISVVENLGLEVQLHA

SEQ ID NO: 6244 - protein, 157 aa, Methanobrevibacter ruminantium
MAFEESIRKASIQSYEGTRKGDTIEEIEAIQNYIRNAKIVVPNKNGIKVEVINEVLAKFNIPPAEYLQVNTNYADFSRMPAIAKAMIAVDQSDADLVIARGRLGIPGSGSFLVFMDSKSRILTAATSPSHIIHNQPLEKTVYKETLEALKKVGFKEE

SEQ ID NO: 6245 - protein, 146 aa, Methanobrevibacter ruminantium
MGGIDESQSESIYTKVFLIEDPIAEDNDDLLKNKNNIYSRISLVNSYNKFILKTEGLNTKTSGTMTLTIDILRQSMNEILSREGVLYCSSEMTFFEEIVFKENDLDKFFELIGSPVIKVSTIAPFDCEEIIKCFIDKIYSEILIRW

SEQ ID NO: 6246 - protein, 242 aa, Methanobrevibacter ruminantium
MYANDIFNIIDELVPRKLALKNDKFGYFGKTFDNFDIKNIKVILDLLPEDDLKFDKGDLVISHHPPLFMPKTPTYVVHSNWDIVQGGANDALAYYLGLKPISIFHKQTGIGRICSSTKTLDQFLALVCYKFGPENVRLVHDGDFDKMLRKIAIVSGFGLSNKEFIKLAKDRSVDAFLSGDLNHSNAIYAKKLGITLIDVSHHIIEIPGLFALKELLRRNEDITVPVEMIDNGVPWKYISADF

SEQ ID NO: 6247 - protein, 214 aa, Methanobrevibacter ruminantium
MIQEMENSLIPKGSIDLVGFGRLGLRTGINLIQVHRGGPAKITVIDGQKISESDIIFLLKGAKVGTYKSDFLKEISTHSKDFREVVSITEDITEDNIDLITGDVVVIEIAGGNTVPTAAKIIKKAHENGSKTIGTAGIFGIGDEEIVVADISEFDDSNPAIEELRKEGILDNHLVISTNRFIRDGIPITPYVLDDIANIITREALKLLIEKNNE

SEQ ID NO: 6248 - protein, 202 aa, Methanobrevibacter ruminantium
MITIATAECFTHGILAREIHALAQDYDDIFASSYWGLVNKVQKDCIKDAILEDKCSIFDLRDLSVSCGLFIPTLDAVKSVLKIENPLEPLTLIDGIKVYDDDGDREMAILMAEAAKKVSGSDIGIGTTAGIGYGGIAIVDDDIVISTSSDVYADLVNVDSDDLYMRQRSGIEKTLKILIYYLNDNLDIINQMNNVKIYNKSE

SEQ ID NO: 6249 - protein, 722 aa, Methanobrevibacter ruminantium
MIFTIEYDKGTRLRVRCGKEAFTKEESYGLAETLIDYDFIDEVKVSHRNGSILVLYNDPKKRIEILRIISKISQDNLYETKASDKAALEELNDKFAIKIAKHILKRYLFKIILPIPLRKLRMLYHASSYIWRGLDSLTSFRADVALLDGTAITASLLTKNYKSVGSMMFLLSISEMLEDYTMQKTKSTLKSSLALNIDSVWKVEIDDEGNEIESQFPLSKLEKGDKIRIRTGAIIPVDGVIADGDAMINEASMTGESLAVHKDNGKAVHAGTVVEEGSIVIEVRSVNDETRLNKIIDMIEDSEELKAGIQSKAEKLADSIVPYSLAATALTYLITRNVTKALSVLMVDFSCAIKLTTPISVISAMKEASDNRIMVKGGKHLEAYANADTIVFDKTGTLTNAHPVLEKVIPCGKYDRDEVLRIAACIEEHFAHSVATAIVKQAEKEGLHHEEDHSEVEYIVAHGISTTYDGKKAIIGSRHFLEEDEGIRFTKKQEKLIEENAEEYSVIYLAIGKKLQGILCIADPVRDEAHEVISQLKALGIENVVMLTGDSENAAKRIAKDLGITRYKSQVLPEDKASIIQEIKAEGHQVIMVGDGINDSPALSAADVSVAMRNSSDIAREVADISLLSDDLYDLATLRLLATGMLDKINTNYRHIVMFNGSLIGLGLLGVIPPTTSSLLHNLSTMLFGYRSTKSVLGEKEEVVIDTNVINNDGALIGQSGK

SEQ ID NO: 6250 - protein, 77 aa, Methanobrevibacter ruminantium
MIKKLSELKSGEQGTLSSYGTGGDLELKRHLLGMGFIKGADIEVEKVAPLGDPMQIKVKGYSVCLRKEEARNIDVEV

SEQ ID NO: 6251 - protein, 65 aa, Methanobrevibacter ruminantium
MQCSMCGYEFDPLEGGPCGACGQCKGCNKAFCPRCGYGNSLSTVKEFDYISKLQAKLRAFKSKAK

SEQ ID NO: 6252 - protein, 208 aa, Methanobrevibacter ruminantium
MHIPDGFIPLWQCAIYYVILIIALYFAGKWAKANLDEKRIPLLAVLAAGIFAIMSMNMPIPFGTSGHMVGGALVAIVFMAPEAAVLVFTAVLLIQALFFGDGGITALGANVFNMAIVGGCVGLYTYKGLNGIIGKYPSIFLGAWLATLVAAVVCALEMAIAGTFPLSVGVASMALYHAFIGLIEGVLTVIVIFALEKYRPDLLAWNRE

SEQ ID NO: 6253 - protein, 449 aa, Methanobrevibacter ruminantium
MSLIYSITSTITRNIEKILRESLLFTIIFNILEFIENQWVNSYFKGLYPSERFLSIVNKSKILKEEIFSPLIVLVTFTLFILLATDPVPRDLQTTIIIAFLSFFIGAIIFPRFILNNQLNQLNDETNTDNKESKTDKSKQIPLFNSYDVYSIGFCLSLIGIVFLFLSIASVGGLPILKSSLRYSLKPAFTMPVFLIIPGIGLMASHYLNQYKNNEISRSQTRFRFLVLTAIGIGTVLTLQYRTPIIAILLMMIIIGYYGKILSVWEVILGALLGVCAIIGIGYLRSLNELAISSNTNIFSTLNSRANFTMHVLNLLNYISGNFGLMHGKMIASAMPGSDLGPRMMVGKLIAWRTEVTVTPTLLGQMLVDFGKLGVAVEMCLLGFLLGTGYKIVKITENSFYIALYGLILTYSIVGVETGILDIQILAYFFISAFIYFAVILKDKGIRIY

SEQ ID NO: 6254 - protein, 53 aa, Methanobrevibacter ruminantium
MIDLDECGVCEKCIPVCPKELIEKKGYTMIIKDGCDDCGICLDMCPLGAIYEE

SEQ ID NO: 6255 - protein, 105 aa, Methanobrevibacter ruminantium
MRFCPKCGKMLMPKNDILKCACGYEEKISAEVAEREYKFKGERKKENKVIVTDNNNIALPTTKITCYKCGGTKGVWWTVQTRSADEAPTYFIRCVKCGNTWRRSN

SEQ ID NO: 6256 - protein, 297 aa, Methanobrevibacter ruminantium
MTTNDKVSDYISFPKTFESYRWYKPILVFIISFIITLILGALIVAVFYLIMGPDFIISIFKGGAESLNTSMNIFFTDLIIIAFIPSLYIASKIVKDRPFSSYSSSRGGWNFRLYFKALAIPVILYIIYLGAESLILGSEGTSHFSIAFLAVLLISVPLQCIAEEYIFRGIIMQTLGSWIGIPLIAIVIQAIIFTLGHGYDALGLLETLVLGIAYGFFAWKTNGIEISSALHTANNFSLGLFIMLGLEASNSSFQLYDKIGGIVYLIILCIIMYYVGKKTDWFGEIPEDSQNIGLLNF

SEQ ID NO: 6257 - protein, 173 aa, Methanobrevibacter ruminantium
MIEIRFHGRGGQGAVTAAEILAKAAFKDGKYSQAFPFFGVERRGAPVMAFTRIDTEPINLRYQVYNPDHVIVLDDGLLNVVDVYSGLKENGEVIINTHEKVESESHKVFDVDATGIALEILGVNIVNTIILGYFAKKTGEVSINSLIEVIKETFPGPIGEKNAVAAQKAYDMA

SEQ ID NO: 6258 - protein, 80 aa, Methanobrevibacter ruminantium
MVSIGCAIYEPGSTRKNKTGSWRTFKPILDKDACVDCNNCLMFCPEGCVNKEHDIDYDYCKGCGICKVECPVQAIKMEIE

SEQ ID NO: 6259 - protein, 382 aa, Methanobrevibacter ruminantium
MAKEIMTTNRAVAEAVKLAKPQVVPVYPITPQTTISEYLAQFVADGDLDAEYIRVESEHSAISATLGASEAGVRVFTATSSQGLMLMHEILFAAAGMRAPIVMADANRAISAPLNIWNDQQDSIAQRDAGWIQLYVENAQEAFDTVLQAYRIAEHEEVMLPVMVCLDGFILTHTVEPVDLLEQADVDTFLEPYVPKFAFLDPEKPMSLGNFADPEYYTEARHDMQVAMDKSMDVIKEVGAEFGEKFGRTYGLTEPYLCDDAEIILVCMGSMASTVRYVVDNLREKGEKVGLLKIRAYRPFPFEEIDEIVKNADKLAVLDKNFSFGIGGALFADLKAKCHKETYGFILGLGGRDVIPEYIEEAVELTKNPVKEVTWLGLKEDE

SEQ ID NO: 6260 - protein, 288 aa, Methanobrevibacter ruminantium
MEFPEEELLAPGHRGCAGCGAAIAVRLALKALGKNTVVACATGCLDVMTSPYPETAWEVPWIHVAFENAGAVASGVERALKAQGKEDVNVVAFGGDGGTADIGIQSLSGAMERGHDLTYICYDNEAYMNTGIQRSGATPYGASTTTSPAGKQSFGEDKPKKNMAFIMAAHGIPYVATASISYPEDFMKKVKKAAETKGPAYIHLQQPCTTGWGFKPEQTIQLGRLAVETGAWGLFEIENGEFRVTYRPQERKPVKEYLSAQKRFKHLDDEQIAIIQEFVDNQCEELGI

SEQ ID NO: 6261 - protein, 166 aa, Methanobrevibacter ruminantium
MEKLIVDNELCDGCQDCEKACAGVHGVPRITIHELDGSYFPIRCQQCEDAPCEIICPTGAMSNLGVDVTKCIACGFCAMACPFGAISIQYSNAHKCNHCADREEGPACVRACSKRAIAVHDIANVIKRKQREHIEKMYGLDKPAKKKGLLSVITTDTRARKPLDGE

SEQ ID NO: 6262 - protein, 142 aa, Methanobrevibacter ruminantium
MDELKVNPELCVDCGLCERNCPNNAIRVHDGVPLFCMHCSPEKAPCLAVCPKGAIVALGGAITIKQDKCIGCGLCHSVCPIGAVTINEIGQATKCDLCADYDTQQCVEACPTHALTNDTEKIIHDKQEKISEGFKKVQTLLK

SEQ ID NO: 6263 - protein, 144 aa, Methanobrevibacter ruminantium
MTFMNNGANIKQFQLLKFINENCNDDHVISKISIVLRRDKIEAPYYMNTKIRLSTCMDGEEKGVIHAMDILNHSRKHNLCEYKYDEIKSLIFDLFDSDHKSDQVEFSQNDNRLKISFMSKNDEEFRNLFENYHELFEKIDGLVD

SEQ ID NO: 6264 - protein, 84 aa, Methanobrevibacter ruminantium
MSDPLIIKKELLFNEYTGHEDGNCLEWVDGRLSNSDDHHRIPCNLEDAFEIAKKQKAVLVIQPEFQEQCIFADFTGEEIDENWD

SEQ ID NO: 6265 - protein, 279 aa, Methanobrevibacter ruminantium
MITEKQIEDTIYQLYKQAAIVLGDDVKSALEDALKREDSELGQLNIKAILKNIELAEEKSIPMCQDTGLPIIFVKLGNVQVENLYEGIRKGVARATEEVPLRPNVVDPITRVNSGNVGDKVPIVDIELIDEDYIEFTIMPKGFGSENNNALKMALPAEGIEGVKDFVVETALKAGGKPCPPIVVGVGIGGSSDMALKLGKKALLGKVGERNGDPTLAEVELECLNRINKDGKGPMGLGGRTTALDVKILKMDTHTAGLPIGVVIQCWADRHATARLRDD

SEQ ID NO: 6266 - protein, 529 aa, Methanobrevibacter ruminantium
MILIITGHLAYPLVKEMADKSKKETVVHIAETQVAAFLTPNQIIKEIHEYFEDRLDDIDLILVPGLIRKDTFLIAEEFGIPCYKASTDAADLAMVLDLVDELELSQSTPADKLIIEEKKKQALKFIEDFEKDMEKREELLKKENNILVRNLPVGEDFPMRVLSEIASAPILSKEDLIKKAEFFVASGSDMIDIGMIAGEDRSDEIPDLIDTLRPIVGDRPLSIDTLNPKEIEAAVNHGIDMILSLDNGNYHEILPLLKEKNVPAVILPTNFSEGYVPHSPADRVASMQKLVEACDGLEVVCDLILDPVNSASLVDSIIAFHDFHEVDKKPMFFGIGNVIELMDTDSVGANAVLAGIAMELGASILFTPEESGKTHGSVRELAIASKMMFLAKNRQSIPKDLGVDLLVFKDKKKRFDLKQDDNVPIVKQDRPIKFVRDKAGSFKIRVEHGISVKDSYIVATHFKKTKPTISFEGKTASEIYEEIIEKGLVTRLDHAAYLGKELEKAEIAMLTGKEYVQDFDLFKDPEEFI

SEQ ID NO: 6267 - protein, 290 aa, Methanobrevibacter ruminantium
MTDEELTIEEIEKKLESTGYISNKEISTSVFLSLSLNKPILIEGPPGVGKTELAKALAQSLERDFFRIQCYEGITFEQIVGEWNYQKQLLHLEAFKGSKKGEDSIFEEDFFIRRPLLTSFMNEKPSLLLIDEIDKADEEVESFLLQALGEKQITVNDLGTFDLQNDLVVMLTSNAQRNLLEETKDRCLFLYISYPSVEREMAIVKARLPNAEDGLVKKVVNMVHRIRTFNLNKKPSVRASIDWVNSVMHLDKDYKNVDAALEDSVGVAIKTEPDKAKVVKEIFRNEYMND

SEQ ID NO: 6268 - protein, 386 aa, Methanobrevibacter ruminantium
MTERIVRLSNDLRKKGMPVSIRSTQTAIDAYALLGEDDLPTLKDAFRSIYVKSKYDIPKFNESFDGFFTKKQVKNLTDELNKSSRPNSMKGKLSQHEWKITKQKGKGGKQIQMGAEQAMEYFAGRPVLEDRDKDLARDNDILNSDLSKLNKYDERVFELCVELGRKIANKQSRRKRLARSNKIDMRRTMRQNMKYGGVPIDLVHVKKKPHRKQHLFLNDVSGSCEWISSWFFMLMFACQKTFKDSRMFEFDNRTIETTEFLKEKYMVNAFAEIRLLRMRNMMVRGTSNMYTAFQSFMKQADISNKSYIILLSDCRDWAGPKVDGVPASVELVSQMSSMAKKLVILNPEDKKKWDVVDSCVSLYRGAGAQVYEVSTLNQLAEFVADM

SEQ ID NO: 6269 - protein, 305 aa, Methanobrevibacter ruminantium
MQSCTKCGNPKIIIKKPASGQALCKDCFIESIEKKVRQTIKRENFIDRGDKVLVALSGGKDSVVTLDILNSYRERHIIDLCAVTIDEGIAGYREDGVEIAKAHAERLGIPHKVVSFKESFGIDLDEIMAKENHRGSCTYCGVFRRWIINRAARDFGATKIATGHNLDDETQAILMNYLEGNTENLAKIGPKTESNDELFTVKIKPLREIPEKEIGLYAIAKGLDIHLAGCPYAEESFRMEISNILKDLTKDHPTIMYSTLRGFDKMRPAIKEEFKSNFVYKRCERCGEPSSNRLCRACTFLEELD

SEQ ID NO: 6270 - protein, 66 aa, Methanobrevibacter ruminantium
MSFKLKIKDNVEEREIDGELTIKKLLDDLDLSSETMVTKKNGEIVIEEETIEDGDEIEFIQIIYGG

SEQ ID NO: 6271 - protein, 239 aa, Methanobrevibacter ruminantium
MSSNATGTRIHQYIKKETGCYDPYFYQKKEGNEIALSLMPMVREILKEDNDLETYVKIAIVGNILDFGTFDLDTDFESLIFEGLKKELVINKIDEFEEALKKYDNVLYLVDNTGEIVFDKLLIEKIKEYDVDITVAVKERPILNDACMEEALEAGLDEIADLITTGSDSVGVVESMISDEFKEILLDSPFVISKGMGNYEGLTEMDLDGQDVFVLFCTKCNAISKDLGLPEGSHILSKL

SEQ ID NO: 6272 - protein, 274 aa, Methanobrevibacter ruminantium
MKFGFIGFGEVSYTLSKLLLALDFEILSSIEGRSQKTIDLINSLDLTLLDSFKDVAKESDVLISANSPDIALDIAKNYGNLTNGFFLDFNNISPKTVFEIEDILSDDKFIDSAIIGRVNSDELNIYLSGSKAQFLLDKIKKEIGSKGIDINKMDFKINVKLISDKIGDVSKLKMLRSSYTKGVSALLVESFELAEKLDLEEELWEILSLTENRDFERSSKSRIDSSKKASKRRYEELVEVLYFLDNVDNVDESKIMARATKDKFEYLKNRENKE

SEQ ID NO: 6273 - protein, 432 aa, Methanobrevibacter ruminantium
MIAISADFDPVHKGHEQLIKKGKEIAEEKNSKLVIYLNKGYSANHAPFFTPFDARCRMAKALGADEVVGVEGLHHRLILSYSVPIRLAQMHEDGVTDYITAADISLEEIKNYAERFINEGSFLGIPQDFPSRNVIRWYAINEFLSKKFNRKIDFHLIPEVSSPKKISGRFIRKEILNNNLTISKEIRELLPKTSIEILEEEIEKGNVPGKRNMKVLKHKMNTYSRSNLTNIAYLNGKVINRIVEGRFYKEDDESIWASFRRADYGPVMTRLAASCIEEEVTKDEVLKLMRHYESKGVIPPEQNVDKIIERAWYVALEVDKGVPAKEANEKFRKKENLKLNPMLSLEAGLNLTKFEAKKIHEGIEAKIFVDKDNKISCEIKDKKIKVKTALKLPSMEVTYLRYILDSRYIPVSGELIKNKRNDFRVKITIHDY

SEQ ID NO: 6274 - protein, 362 aa, Methanobrevibacter ruminantium
MEIRELTKEIRDRSIEYAKPKDLDNLSASWYQEDLLYSGKGKTIFLILPTPGCSWALGPSGGCTMCSYISDCYLKPIETSKIIELFEMELGKWDFAEDYKNGEKIAIKLFASGSFLNPEELPKEARNYILQRLADLDEISEIVVESRPEYVKKEIIDEIFEIIGDKLFEISIGLETSNEETRLNKINKGFNNKSFERAIDTIKQSKESYDIKSKAYIFVKPILLSESEAIEEAIETASYCESIGVDRVSCCPATIHRGTLIERLWRRGSYNPPWIWSTVEVINRIRENVNIPALMDTSGFGSRRGPYNCKKCNKELKHKIIDSNFDQSQIEHDCNCKSEWIAEVKFSNLNRSKTQTKHLPLY

SEQ ID NO: 6275 - protein, 69 aa, Methanobrevibacter ruminantium
METNRLEAFYDAIIAIIVTVLVLELPQPETATIAGILALKVSYFTYLVSFLVCQSLAISPLDICSCEKN

SEQ ID NO: 6276 - protein, 160 aa, Methanobrevibacter ruminantium
MFIEKRCTGCREGSACYLTCTIAPCSIEHGNIDYCFECEEYPCDKYDGIELYDSLITHRNQKKDLQKAKTIGIENYHKEQLEKKEIINHILNRYNIANRHIFFCLAVNLLEVDDLKQILKDCDESTKDMDLKERSDYIKHELYEFAKKRNIILKLNTGRY

SEQ ID NO: 6277 - protein, 83 aa, Methanobrevibacter ruminantium
MNYVEEAVQLFEDGYMCSQAVLEVFCEEFGLSREQAFKISISFGGGMRKGEVCGACTGAIMALGLKYGDFERMAQIRRNKRSL

SEQ ID NO: 6278 - protein, 151 aa, Methanobrevibacter ruminantium
MDDLPEMISIWNEIVEEGNAFPQEEVLTLKTGLDFFNSQSHVGVAFDGEILGLYILHPNNVGRCSHIANASYVVSSKARGKYIGQKLVLDSIEKAKELDFLILQFNAVVEDNLSARQLYEKLGFKQLGVIPKGFRLDNDEFANICPYYIEL

SEQ ID NO: 6279 - protein, 219 aa, Methanobrevibacter ruminantium
MNYQEISNIIKESLNLKTSPVSVKLFEKEKDAEEIFEKTNKTIHCQAIITASKGKSFYGTIDEIGCPIGAGILGLKELPEKILNGSQFDKMNVTSSQESGKALIDSVAKNNRIEAIAYMPLEDSKIEPDVVVVIAKPRQIFDLIRANTYQEGKRMDNSVGGTQSLCGDIVVNSIQTNEPHISFGCIGSHMATELSEDQVIIGIPISKLEEIANSLNIIN

SEQ ID NO: 6280 - protein, 249 aa, Methanobrevibacter ruminantium
MKFKFNTPLTEGKIIKRNSQFTLDVEINDNIEKVHCPTTGRIGNIDLKNVAGLLSKSDNPKRKTKYTLEAISISNLNRKDKKWIGINQIASNKYIELFLKNHLLDGMLPEYSEIKREVSLGKSKLDFLVGSTYLEVKTPLQTLQIEYDTDIKTKKVSSFSSTDRFIKHINELADSLESNEKAILLNTFQYDNPGYEILNPSTNYIEVSENVDRCIEKGLEIWQVNMKIDHEGVELLKYWNTTSNFRKIK

SEQ ID NO: 6281 - protein, 169 aa, Methanobrevibacter ruminantium
MKSKDKIVKSLIELMETHEFEEITVKDISELAEVNRSTYYRNFKSKEDIIKYKLESIMDEYLKEFESKTDKTKETYIRTILETFLKHEEFLKIIHKQNQSYILQKVLANYFGDVLKDTSKKERYQVYYHIGGIYNFTICWIENDMKDRPEYLAKIGAEITSNIEPYLLK

SEQ ID NO: 6282 - protein, 329 aa, Methanobrevibacter ruminantium
MGCMGFGDPENGMHTWTLPEKESIEIITNGLHNGINFFDTAIGYQNGTSEQYVGKAIRENASREEVVVATKFLPRSQEDIGNNVSGRQHIHNMVEKSLINLGLDYIDLYIYHMWDYNTPLYDLLEGLNEVIEEGKVKYIGISNCFAWQLAKANALAEMEGFAKFVSIQGHYNLIFREEEREMIPLCHTDNIALTPYSALASGRLSRLPGEESKRLNEDYYAKLKYQNSEQQDLKIIERVNELAQNYGVSMTEVSLAWLLTKVTAPIVGATKMHHVEGAVSSVDLTLTEEDISYLEEPYIAHDLVGVMADNKVSASDNEKVWIKHTKNKI

SEQ ID NO: 6283 - protein, 177 aa, Methanobrevibacter ruminantium
MKIIVLKGSPNINGSSNLLADNFIKGAEEAGHVVGEIDAAHADIAPCSGCVSCGYEGPCIISDDMDIFREKILEADMLVFVTPLYYYGMSAQLKILIDRFCSANSSIQSSHFKSALITVAYNSSNWTFDALEAHYDTLVKYLNLDDQGRILGYGCGTPSMTKYSDYPKKAYEFGKSL

SEQ ID NO: 6284 - protein, 466 aa, Methanobrevibacter ruminantium
MPNFFSGGDLISNNKPQETFRGKTDRAIKKRPPWKEYNLHIVCFVLVAISMAIGVKEIRITDTISVLLLPLIYALIMGLALFLAKPIKFIGKKQSKVAEGAMVLFIGVLIAKLAISSGQSIDIIFNVGPSLILQLLGDLGTLIALPVALILGFRREVIGMASSICREPNLGVIIDKYGFKSPETRGVLAIFVIGSIIGTPFISFLSSICISLIPYHPYAFAMASGIGSASMNAAALVPLVHMYPAMATQLEAFAGCSNILSFCLGIYMCIFISLPLAEKLYKWLSPIIGKGEGRTIDDEYAIEGVKDDKYATSEDLSSGKIERWVTFLVLFSIIGTVGNFIGYHTPLLDVFIGMLIISIITLIGMCLERIIPWDIPSIIYISLLGIFLAIPGVPTSDIIITYVSQIELTTICTAFLAYVGIAIGNDWEEFKKIGWKGIIIAIIVISGTYLGSASIANLVLFVTGMI

SEQ ID NO: 6285 - protein, 297 aa, Methanobrevibacter ruminantium
MARSDKTLEDILNIIFYDKPSTQDEIAEKLKISRRYVTQLLKPLIEEDIVKRAYVIDLNKYDEIYGSSDPIFNLKQHSAFFLIENMLSSMSEHVKEQVQMSFDAILTNDKDLAEQALKLDFTTNNMYEKVRASVETVVDVDPHSKLSKILLFSEAAYNYERIGDYSGHIAKFVINEKTAVDDELLDILKKMHKYAQKSISYATDAFINGNIDSRGNLMDTEEKIHETQQKAMNLIANQMVETSFEDIEMSNYYIYISRVVKSFERMGDISVEIMDLAAEFHKDIPRPTTPRSFREKI

SEQ ID NO: 6286 - protein, 644 aa, Methanobrevibacter ruminantium
MEGSELQNIKGIGDKLSQKILLNLGGEEELNRVINELDLERLIQIEGISQRKAIEIMNQLLGNPAQKFLKSERAIQLYEEIIEKILKYSNTNYSKNRILLLAPIKDEFIIAERLSFVMSAKERVSKLPLDELNKLMRNLHEPKNAKANYDASKAILVESAEDSDYLMDLGLNKYYTILTASDSPFFKEEISGYELVYYIYSEGILDFGDMPNLIMISKEAEDYQLVPEIILDYFKENRELFENVCKIRKILGESTVLEDVGPVLEELDNYKTQEIDLDGIVQEEKTYIDEELKTRIHNVDLEGDEVLDLLNNALPPKIEKIFDEILSKSKENIKAKSGIDFDPFIKKYPIEIDDMEMERIKMEILSSSENNYFDMKITAAEHLALIKEQAEREVKETIEFDFEYALGSFAYHYKLNAPEFSNEYALEGALHLELCLKETEEDNENGEIQRIDYKLNEQENVALLTGANSGGKTTLLETISQIAILAQMGLPVPANMAKIKLLDEIYHFSKKRSLDAGAFESFLNVFMPIVTSDCEKLVLLDELEGITELEAAVKIISSFIEMIKDSNSFAIIVTHMANELMKYTDIRVDGIEATGLDENYNLIVDRTPKMNYLAKSTPELIIKRMYENSSPELKKVYGKILEKF

SEQ ID NO: 6287 - protein, 1017 aa, Methanobrevibacter ruminantium
MKLPELLAPVGSAEHLKTAILSGANSIYLSGENYGARKYAENFSLPEIREAIKYAHLHNVKAYVTVNTLIKEGELKKVSEYLLQLYKMGVDAVLVQDIGLINIINKHIPKLNIHASTQMNLHNIEGIKWAYDHNIKRIVLPREIEMRELKEIVEYAHSLGIEIEIFAHGALCYSYSGHCLLSSLQGGRSGNRGRCAQPCREQYELSINKSKRISPKNEGNYLLSPRDLSLYENLDEIVNLGIDSLKIEGRMRSTDYVATVVKNYRKRLNRLRYDKTSKSLNRNINESIKKTKKGKKGRKSDLKKIEDKEKIESLKKIQKEENRNSEEELGLVFNREFTAGHLIPKNNPMIMNRKKPGHQGLYIGNIHRYNPQTEEIHILLNDNLIHIPEKGDGILIESRINRENSDERNNKSNKNNKNKQNESKSNKKDKNKKKIKRMENDENYHSIIQTYGFDISSKPVLKDSKDKHWRKREKDKDIEGKLLVIKRVRENKRIPFPLEKGSKVYLTKRNSLINEVKNLKSDKSKHMIKKSNLELYFRIDSDNYPHLKGNLKLDNGKVITLKIRGEMPWEEAIKKPITNETIKKQLMKIGDLPYYIEKITVNNNKSLFTPISGINELRREFFDKLEEEVINSYIPTDEDIKIAEENIKELSKELDRKIDLKAKVKSEQENNDLKSNAKLENKNKNSKNLSIYINSLESLKEINKINDLSNTLFNRIYLEIPPNRRLDEITKDRIENYNPNDSKELNISYCVNFLKSAINLAQDQDYELIWKLPDIAHKQSKESIVKILGILNKMNLHINIMTSLIGLDDSLKDKFKLELYGNYPLNVYNAYSVMELKNYKTLCISPELYKKNIEKLMEDYYTNKNNEGLSEMEILVHGKIEAMTTRKELISKKQLKLIDKYNKKMRRDKMDISSNEFYLKNRKDQYYPIRTSINEDNLIILNSEEFCLIDEIDYLKSIGIKNYSIDCRWKGIDYIRDIGMVYRDSLDNDDYDLGEFKEIINKHSEQLTKANFDIGLK

SEQ ID NO: 6288 - protein, 861 aa, Methanobrevibacter ruminantium
MTLPELLAPAGDYDILVTAVNAGADAVYISGERFGARAFAKNFTLEEIEKSVEYAHLNGVKIHVTVNTLINNFEVVDVVQYLFKLYKLGVDAVIVQDVGIIELIKTLIPGLEVHASTQMTLSDYDCILWAVENGISRIVFPREISVDKIREISEKLKSSNLNMELEVFGHGALCYCFSGNCYISSYNSGRSGNRGACAQPCRKQYKLKYKNYNVGNGFLLSTHDLAVYKGLDKIEEAGVFSLKLEGRMKSADYVGTIVNAYRHIIDGDEGDYEKDLHLVFNREFTDGYILNQSPGQVLGRESSGHEGVYIGKIIEKKGEQIKISKENKDFSINLDIGDGIGFKYKDKIKGIYIDNIKEQTDDYIILNTTRNVREGDKVLLSYSKSTHDKLKKFHNETIKQHIPLSLDIYWNEDLSLNVTGRFQIEEKGINNKNIIERFNFNYISETKFEKALNRPISKEDIEKQMLKTGDSSFYIKEMNIHGMPENTFIPIGKLNKIRRRLLEKATNLLLDYYKPSKKEVRATNKKVNQFIKEYKTYSDIDLRKEKLNLSIFVDSLELLEMTRKLPIHKYYFDPSFSFNSPEEYFEKIKDLLKEAYSIVGNSNNPNNKSKSNEDERLVLVLSSFISDEEIEKLSKIIDELKEEGISIPIMYDTPGIGKSFNTDIYGNHNLNIWNSYNVKNLSESGFKSLILSSELSHKEIKELVSKYQYIKGDKETDLNIIIQGNLEVMSSKDDFSNLNDGKDFIINSADDYAILEDKKRKKFKYKVVFDYNKHSHFINKDCLCLIEEVELIKDTGVDSVIIDTRFSSAKYSSTIISLYLQALKEDNTYDLSLLKDQIRNITLSRLNQGNFINGRLHEKDC

SEQ ID NO: 6289 - protein, 196 aa, Methanobrevibacter ruminantium
MYIVLEGIDGAGKSTQINYLKGWLEDNGFKVETIVEPTDLEVGNLIRQLLTRSDATSDTMQKTLGLLFAADRLVLMDKIEKLESERTVVISDRSFYSSLVYQKPQDWIREINKFAKIPDLVLLLDLDVKKSVERCDGTDEFENEEFLTGVKENYLALSRENDNFKIIDANNGPNKVASDIKKAVAPLFDICVDCIR

SEQ ID NO: 6290 - protein, 68 aa, Methanobrevibacter ruminantium
MEEEPIYEMKLTNGIGEQMLAHVFEKFDVELKQTEFGPKLQGTKEELEKAQEYIVEMMKKRLEELDRQ

SEQ ID NO: 6291 - protein, 321 aa, Methanobrevibacter ruminantium
MNIEEKIELIQEGTLEIIELEELKQKLEKETPIAYTGYEPSGKIHLGHAVTIMKLKQLQKLGFKIKILLADYHAFLNGKGTVEEIAETAEYNKRCFQGLGLADDTEYILGSSFQTGSEYTNDVYQLATITTLKRAKRSMDQVSRHDDNPKVASVVYPLMQTADMSALNVDIALGGMEQRKIQMLARENLPRIGKEAPVCIHTPLIHGLDGDDKMSSSKGNYIAVDDDEKTIKEKIRKSYCPQGEIEGNPMIEIADFFVFSQQDTFVIERPEKFGGNLELTKDELHTMYSEGKLHPMDLKNGITKFLIDFLKPVREFMESGE

SEQ ID NO: 6292 - protein, 346 aa, Methanobrevibacter ruminantium
MFCPECGATDVEMVDGICKNCYLKKFQLMEIPENITVTICKHCNAKLEEGKWKDEYIPEDEIIYRTLENNIKLNDLAENEEIELEIDQMRGTIAECYIEAVATVLGEEIVETHTPNVKIKYSVCPDCSKRNAGYYEAVIQLRADNRELKEDEIIKAEEIIGRTLDKQFKKDKLAYIPQVAKLKEGNDYYIGSLKSAKKVVEHLKEELGGKVKESPRLISEDKSTGKGLYRIWISLRLPKFEKENIIKYNDKIYRVEAIDGNRILLANLENQDSLALKWREYDSIEKMENLNGIQKAIITAKSPKSIQILDPDDFSPLDLDMNEKLEGFNIGDEIDILKIEGRIFII

SEQ ID NO: 6293 - protein, 135 aa, Methanobrevibacter ruminantium
MDDYENLLNRAIDQLPPEVFETKRFEPVKAYSVIQGNRTFIQNFKDVADSLNRDPQHILKYLLRELGTAGNLEGVRAILQGKFNHFLINERIDEYIEKYVICHECNRPDTKIIREDRIFILKCAACGAKAPLKPL

SEQ ID NO: 6294 - protein, 665 aa, Methanobrevibacter ruminantium
MSPTNKTKASLARFEEFFSTIYKDDVFEVLEKYPDERSLTVDYNDLEMFDPDLADLLIDKPDEVITTSQKAIKNIDPLMKDANLNIRFENLTNNVPLSDLLSKYIGKFVSADGIVRKTDEIRPRIEKGVFECRGCMRQQEVEQTSSSRIMEPSMCTECGGRSFRLLQEESKYIDTQSARMQEPLENLSGGTEPKQMLMVLEDDLVDELSPGDKVRITGTLKTFREEKSGKFKNYIYVNHIEPLEQEFEELHLSEEDEAKILELSQDPNIHDKIINSTAPSIRGYREVKEAIALQLFGGSVKHLEDKTRLRGDIHILIVGDPGIGKSQILKYVSKLAPRSVYTSGKGTSGAGLTAAAVRDELGGWSLEAGALVLGDQGNVCVDELDKMRSEDRSALHEALEQQTVSIAKAGIMATLNTRCSVLAAANPKFGRFDRYKTLADQIDLPSPILSRFDLTFVIEDKPNIENDRKLAQHILKIHQSESVNYEIEPDLLRKYIAYARKNINPVLTDEANKVLEDFYVSVRSAGVEEDTPVPITARQLEAIIRLAEASAKLQLKDKVEAVDAQRAITLQRKTLEQIGLDPETGQLDISRVEGGTTTSDRERMQKIEEEIKLLEQEFERAPIDTLKENMKEKYDMSPEKVETLVKKLKGKGIIFEPRNGFFNTA

SEQ ID NO: 6295 - protein, 213 aa, Methanobrevibacter ruminantium
MGSRWQVEKKKDPYYRRAKSEEYRSRASYKLKQLDKKYKIIKEGNTVVDLGAAPGGWSQVALEKVGEEGIVVGVDLNRIKPFPEKNFYGIRGDFTKEIVQDKIMELTNGKAKVLISDAAPSLTGIKTIDHLNSVDLVETVIKIADNILETEGNMVIKAFQGPEYKRLLDEIKQDFRKVKSTKPPSSRHRSKEMYIVGLGYRKGPGSRKSRNKE

SEQ ID NO: 6296 - protein, 179 aa, Methanobrevibacter ruminantium
MLIGLISDTHIPDRRMKLPQKVLDAFEDVEMILHAGDITSQSVIDDLEAIAPVHAVEGNMDRVVGEMNLPPSKIVEAEGHKIGIVHGEVYPRGDTQQLYYTALELGVDILVSGHSHVAQLEKIKNVILVNPGSPTNPRLSDPSVAIMEINGNDINFEFVKVGNPVCSALNFFKDKANKE

SEQ ID NO: 6297 - protein, 363 aa, Methanobrevibacter ruminantium
MGKVSKEKILEILDGYDKENITIATLGSHTSLHILNGAKEEGFRTAIVCEKGREVPYERFEVADEFIMVDEFKDIVNEDVQQKLRDMNAIVIPHGSFVAYAGLDNVEDKFNVPMFGNRDILRWEAERDLERKLLVNGKIRIPMKYDDPSKIDRAVMVKFPGARGGRGYFVASSPEEFDAKIDAMKERGWIEDEDVAQAHIEEYVSGCNYCIHYFYSALNDEVELMGMDSRYESSIDGFVRMPAKGQLSIDISPSYVVTGNHPVVMRESLLPQAFEIGDKLVKSAAELVKPGLNGPFCIQTLVNDNLEVVVFETSARTDGGTNTFMEGSSYSYLKYGEGMSMGRRVAREIKNALENGGFEKIIT

SEQ ID NO: 6298 - protein, 124 aa, Methanobrevibacter ruminantium
MAKMNAVILGFILTLVVYLFFGRYEFWGLLIVGFIVGYIAHEGILGGMWNAALAGAFGTIISAILFIILVTIGGTAMMGFLGGLAGFTVSGITSLIDIVFTIIKYMIVMGITGAVGGALSGEKE

SEQ ID NO: 6299 - protein, 865 aa, Methanobrevibacter ruminantium
MIKKQTKTYSKKQIYKNLHPFVREWFENSFEDFTPAQKQSIPEIQKGKNILVSSPTGSGKTLTAFLSVINELTTLADKGELEDKVYCIYISPLKALDNDIERNLDTPLKEIEKIAGKPLNIRKSVRTGDTTQYQRNKMLKYPPHILITTPETLSILLVAPKFREKLSHVKYVIIDEIHSLAENKRGVHLSLSLERLQALIGGFVRIGLSATVSPLEEVARFLVGYEYGTERDCLLVDINYLKELDIEVISPVDDIVIADSEDTRLATYALLDDLIMEHKTSLIFTNTRSATERYVYNLKKLYGEHFNSNNIMAHHSSLSKELRLETEEKLKKGELKAVVSSTSLELGIDIGYIDLVILINSPKSVSRALQRIGRSGHRLHEKSKGRIIVTDRDELVECSVLLKNAKEGKIDNIKIPKNCLDVLSQHIYGMGIENPWDIDYAFDIIRKSYCYKDLSRDDYEDVLSYLAGEYVELEERYVYAKIWINYEENTFGKRGKLARMLYSTNIGTIPDHSAVIVKCDGEVIGKVEEDFMEKLKKGDSFVLGGRTYKFKYGKGMTINVSPASGPPSIPSWYSEQLPLAFDLAVDIQRFRYILDSKFQYGRSKEEIMEFLHDYLYVDDFAANSIYEYFNEQYLYAQIPHKQKLLVEYYTGFGGRKFVIFHSLFGRKTNDAIARAVAFLASDFNKRNITISITDNGFYLSSDGKMGALEALNRLNPQNFENILIKSLDKTETLASRFRHCAGRSLMTLRRYKGHEKSVGRQQVRGKILLKHIQEMDNNFPILKESRREATEDYMDIKNAKRVISWIDSGEMEIKTINTIIPTPFAFNLVSQGYLEVLHQDDKAEFTKRMHRAVLDKIKEEMDNQF

SEQ ID NO: 6300 - protein, 283 aa, Methanobrevibacter ruminantium
MVEKLSIDEAIEALKDEDVANRKLAIKSLEHKSDDKIIEPLIEATKDENAQVRFGAAEILGDIGDSAVDKLLDEFNKESGSNKRFLAVALQKTGSEKAVDAFADALNDEDFGVRKVAVRALGELRAEDKIDAIAECINDEDGGVRTAAIFALGDIGTDKSIQIIKDARRKEKDKDFKKYCNKAIKQAEKVQKSGGKVKSSKGQPMSTIKEMEKQDPEAAIKAYEVHVKSGSTKDTPYKRLAILYRKINDYDNETRVLKLAIEVLSKENPSKVGWFEKRLEKMT

SEQ ID NO: 6301 - protein, 268 aa, Methanobrevibacter ruminantium
MDIFNYIFQIIVSVLIFAAIFAVGILLRDKIVHKLNFFVNPQNYLPEEEIQTLKQVYYLILILILVVCILNFFFDNNIILPNSPEFYVFNSFLDIIVSVYIAIIIYDGSKKSKILLIFLIPIPSIAFLLFGESLIEYWDFVRIPALLYIMKIFYDKFHIYTDKYNLEKSILLLFSIVFISFIITLVAENEDPLNALVMVSNAFTSKGYTILGESTIGKIDSIFLVWGGYIISGAATATLTAAILIKHFNAKIEKFDEKFEELEKLISE

SEQ ID NO: 6302 - protein, 281 aa, Methanobrevibacter ruminantium
MNKIKIALCQMNVVDNKDENIKKAIEMIKESKKQGADLAILPEMFNCPYENEKFIKYGETLEDSRTLKSISETANEENIYVLAGSVPELVLNDSSNENNLYNTSVFFDNEGKILGKHRKVHLFDIDIKDKIYFKESDTLSAGDDFTIIKTPFARIGIGICYDIRFVELSRILALNGAEILIFPGAFNLTTGPAHWELLFRSRALDNQVYAIGVAPALDKEASYNSYGHSIIVSPWGEVIEELDYDEELKIVELDLDLIKQVREEIPVLKNRRTDLYDINEK

SEQ ID NO: 6303 - protein, 392 aa, Methanobrevibacter ruminantium
MKYCQECGNASYDSAPVCGNCGAKLGPKSEANSTPPSRDKKAKSTSTSSESSIFSSKSDGFSSKIGKKIGSFQVSSTNTAVENKQEREEAFLKQTSKPSFSKTATEGFKQKDKGIKNPATKYNMPKKEETVDAKAKEAPKREAPKKEIKRESPKKEVKKEAPKKEIKPNIVKKSDEGSSGGINLKKIGIIAIIILIILLIAGIGLNQMQNQTTDEVMNYTDGIINFTYSGNWSVYNNTNADSNMTDLAFKTKDKTLIGFTTIQSDEITYEKILSDVNDTAHSLNGEILEYQEVNVGGVPAQEIIISTQDQGYSRYLCILHDGVYYCFVANNAKSDNQNLTSLNTTEIQNMINSISFKDVVAGDTANLDTSYQESSYQEESYDNYNYEDTSNY

SEQ ID NO: 6304 - protein, 166 aa, Methanobrevibacter ruminantium
MVKKEKIKCDNINYAVYRIDDWENDYEINIIGTAREIPVTQPTLEHMLKQMDHIRQSVFEIGGKKVNGMIGLSMQFNPSFASRDIDELIEQEQKEFDSIMAELNALELKDAKDVIFLDTDEYVIYKLEYDGHSLSPKPYNDYAKQHHLDEIKRLKELSGERFVLEL

SEQ ID NO: 6305 - protein, 241 aa, Methanobrevibacter ruminantium
MSKIQQLQEIINSSDNIVFFGGAGVSTESGIPDFRSESGIFKSLEKYGDVPENLVSHTYYSDHTEEFFEYYKDTLVFDGAKPNPAHLKLAELEEKGKLRAVITQNIDGLHQKAGSKNVLELHGSIHRNYCQICNKEYSLDFILKSEGIPRCDCGGVVKPDVVLYEEPLDNRILAYAIDYIQNADTLIIGGTSLVVYPAAGLINYFHGGNLVLINKSETGFDYMANLVINEPIGETLSQIRV

SEQ ID NO: 6306 - protein, 260 aa, Methanobrevibacter ruminantium
MKYKILENPNYKEAYELIEEGLVKKATMLLFACCKVSYEGRALSELDYGERIIMIKPDGCFLIHQDNKVDPVNWQPPKSKTKALIKDETLYLESHRRKPPELLEVEVKKIHYARYNLIEDYEELERAGYEKDMGDMIWDNPHIIEEGFRPTVREYATEHGFIDILGKDADGNLMVLELKARKAGITAVKQIRRYLTDFENRENKEIRHEEEKQKVRGLLVAPSIGDDALELLEEEGIEFVSVEPPRELKKDKKVTLDAFK

SEQ ID NO: 6307 - protein, 255 aa, Methanobrevibacter ruminantium
MQKVINSHCHIYPDKIAAKAVKGIRDFYDLHMSLNGTVDDLIEDGKKVGVVHYLIHSVATTPKQVESINEFISFEVNTHPGLFTGFGTPHPDSEDIERDLDHIIELGLKGVKVHPDFQQFALNEERAFRMGEAINERGLPIMIHCGDFRYNYSNPEQLRPFLEEFPDLTVIGAHFAGWSMWEKATEELAGTPNLIVDCSSSLYSLTPETAKDLIHAYGADKVLWATDFPMWESVSEMEMFNKIDLSEEERNTYSL

SEQ ID NO: 6308 - protein, 332 aa, Methanobrevibacter ruminantium
MFDVESIEVEYFTLKEFKFKNGEVLKDAKVEYITFGTPKYDDNGIINNAVIYFHGTSGNCHSAKRLCESMGSGDILDTDKFFFISLSTLGSPNSASPSSTGLMNKFPEYDIEDMVNFQKQFVEERFGITHIKGLIGNSMGGFEVLTWGCVYPDSVDFIISLVSSFKVGGHNYILSKVIDNIFTSDPDYNDGAYDLPISDSLKRSLKLSSDAMYSFGLSREEYRNNLTNEELTEFMAEFAEESLEEDPNDVVYMNKASIDFDISEDLKNIKAKVLIIAINQDQYFPPNLDAIPMSKMIENNKLVIFDSCMGHVGSGELFKIEDDLREFLTEFY

SEQ ID NO: 6309 - protein, 134 aa, Methanobrevibacter ruminantium
MEITYKDTHDFKEEDLKDLFLSVEWSSGHFPDKLVIAMKNFETVYSAWDGDKLVGLVSAMDDGIMTAYVHYVLIRPEYQGKGIGKELLKRTTDHYKDYLRIVVVSYNEEIEFYEACGFEKADDASPMFITELWT

SEQ ID NO: 6310 - protein, 94 aa, Methanobrevibacter ruminantium
MFSVKVDDYGETEDDMHFVTYMISGLSEAELDYLIANLEGELALEDGNLFLNIFYSKQFFPFGSDDAHFKLDDFIKREEIEMTYFIASFLEDMK

SEQ ID NO: 6311 - protein, 305 aa, Methanobrevibacter ruminantium
MTTELQNEIIQLKEEKNAIILAHNYQPKEIQEIADFLGDSLELCMKAKEIDDKDIIVFCGVDFMAETAYMLNPDKKVLIPDIEAECPMAHMLTGEQVIEAKKKYPDAAVCLYVNSLGEAKAESDILCTSGNVKKVVESIEEDTILFGPDTNLGEFVQPFTDKKIIPIPGDGHCYVHKLFHKEDIDDARKKYPNAEIIIHPESNKEVQDMADYVLSTGGMLSHIRDSEKQEFVIGTEVDLITRLEAEFPDKTYYPLLEGAICKTMKLHTLEKLKDCLVNEEPLITVPEDIAERSISAVERMLDASK

SEQ ID NO: 6312 - protein, 303 aa, Methanobrevibacter ruminantium
MEIIFLGTSSAVPSRERNHAAIVIREFGEVFLFDCGEGTQRQFIEANVSPMKVDKIFITHFHGDHILGLGGLIQSMGLRQREEDLDIYGPRGLKKVMNAITHTGYFKIDFNLNIHEIDEGIVVETEKYRIETTKTKHSVPNNAYSIIEKKKPRFIREKAIELGVPVGPAFGKLHRGEEVEIDGKIIKPEQVLGPPRKGLKVTYSGDTRPSFKLIELARDSDILIHEATFEEEDRLHAYEHDHSTARDAADIAREANVGKLILTHISPRYQEFSVLEREAKEAFDNVEVAEDFKVFNINSKDKE

SEQ ID NO: 6313 - protein, 276 aa, Methanobrevibacter ruminantium
MDDIIKFMLEEDEGFGDITSNALIPQDKVFYAKLISKDEGILAGIEIIKEIFLEYGIDILSSKNDGDEIKKGDILLEIEGNARKILLLERTALNLLMRMSGVATKTHRVVSSVKEVNDKVRVAGTRKTAPALQKYDKIAISIGGGDPHRYGLDDMVLIKDNHIAVVGSVKDALRLAKENVSFSKKIEIEVESADDAVIAAENGADIIMFDNMSPKEAQDSLDALIDNDLRNGVLIEISGGITEDNILDYAPLDVDIISLGSLTHQASSLNFSLDMD

SEQ ID NO: 6314 - protein, 85 aa, Methanobrevibacter ruminantium
MAELDNNIKEKLTEVFKEELGKDDFELNYLITDNEITFFFGISEGKELSLDGIEKISSIIDGGYEGNSIVNQEYRYKFNLDPCSD

SEQ ID NO: 6315 - protein, 698 aa, Methanobrevibacter ruminantium
MENRYQEHQSDFKYLLIINDDLECEIKIRREGNASEKNLKDNIFTIKEASDKELEDIGRIYDLFDQFAIENTRYEKIQMDKKAFIKFALNIKPILRDNNAELISSKEIIESDLKLIMDTDLKENEFSLKKLNRIKWIVRLNKGRIALRDFDKQTENNKEILITRNYFFILNRNEFLDIKFYASSLLKTTENSEILKLALSEEIDGFKFEVGENLKRLINPSRVYEVPRTLKGELRTYQKIGYSWLVQNIRSGFGSILADDMGLGKTLQVLTAILYFKEKGLLEERPSLIVVPPTLISNWEHEIRKFTPELSYYIYHGTNRRFPLEDYDIVLSSYGVIRNDLDLFLDKEWFLYIIDEAQNIKSPHTQQTKAIKEVNAYNKIALTGTPIENRLTDYWSIFDFTNKGYLSSLSDFKDSYVFRIERLEDERSLENFLAITKPFVMRRLKTDEQIKGELPDRIVNDIYASLSKKQIKLYNAVLDGIFEEIDELKGIERRGTILKTITSLKQTCNHPAQFLGSGKPKIKESGKMELLITILENIMDMDEKVLIFTQYVKMGEIIQDLVSKKLKREVLFLHGSQSRNEKAEIIDRFQEDDNYKILIATLKTGGVGLNLTAASNVIHYDLWWNPAVENQATDRVHRIGQEKDVMVYRFITKGTLEEEIDSIIKTKLDLAEKAISVDETFITEMTTEELKRALSLRL

SEQ ID NO: 6316 - protein, 144 aa, Methanobrevibacter ruminantium
MAEDEKIEEIEEIEDKEEENLPFAKAEVVRLMKENLDDDKMIRERVKVEMNKFLGDILKQVCEQLNDYPYTTIEYEMLKESIYPYTNIKRINQEKERILLHLNAIKADCDALAMDVEKTLKLKDVADEDAFTPLSEAQDEEMDE

SEQ ID NO: 6317 - protein, 221 aa, Methanobrevibacter ruminantium
MKHRLNLDNKDPNYILLKEIFKIMDSRKSKSILASYGFKNLNRTIFTFKIIFISMFFGIDIPFILNELKSKKELRKYFNISEVLTADQVYKIFSEINSEKLIKCLNRILNSRNMVKRRGKKTFIVDATPVDVDINFHRNKKTKEHLEKINLKWSYSSSKGYYIGFKATVVLDYDSMNPVCILVHSGAPNDAKLFEEILENLQKRRIIRKGDTLIFDKGYYS

SEQ ID NO: 6318 - protein, 36 aa, Methanobrevibacter ruminantium
MDDILTYPLAVFNKTKRIMKEKRLYNSLKMELMKKK

SEQ ID NO: 6319 - protein, 115 aa, Methanobrevibacter ruminantium
MIELNKKYVFHVPLYKYKDEELIPIDMDDILDELIDEFYQNGYDSLYMTNIETYYKYRFLTEILISIFVSTERLAKENQEFPDRIFKKWFKKNNKILEQEAFAYEYNNKMFIEKL

SEQ ID NO: 6320 - protein, 199 aa, Methanobrevibacter ruminantium
MTKDDIITGKQAIIKMDCPVCGGNKTANYITQTHELAYFGEIVESTIQCEKCGFRHSDIITTEQKDPAKHSLIITKKSLNSRVVRSQSATVSLPEIGIKVEPGPKSEGYISNVEGVLIRFKQATESALRMFDDEESQKNANAVLDKINQVLAGELETLLLIEDPFGQSKIMDVRAKSEPLSDEELKNLKTGFTVIDDEQ

SEQ ID NO: 6321 - protein, 350 aa, Methanobrevibacter ruminantium
MYSITSVEDLQELNPYVIIGCGGGGEKFSNLEGIETVGFLDDNPEKQGKLFCGLEVASNLSDLFESTDANTVAVMLPIGAEGAALKYAVEALANGKNAVVSFRSLSLCENESLLKLASQNDVVIKEISPRLDVVREICGTAPEKCCEVLPKISYEPKAKVVFVGGTSQECGKRTTTKSLGIEAEKRGMKAAVISTDEMGLEKPTVFNFRAGSLSAMDIPSAILSSMKYVEERDSPDIIFIEGQSSLTEDGNPHPRGLSACILIGANPDAVIVGHRPNHPYREPRGIDYEVKAIEAVVPTTKVVGLSINLRNKDEGMTVEDFEKEYGLPAADMYDGGASKLLDAILDYLDE

SEQ ID NO: 6322 - protein, 94 aa, Methanobrevibacter ruminantium
MTKMEIELNDEQLEKVKILESHDISVGDAIDMLFEARDRVISIIDDIDEKDLEDDTPNTEEAKAEQTQLTVKTYDIAIEDYKSHISWANDFFKL

SEQ ID NO: 6323 - protein, 322 aa, Methanobrevibacter ruminantium
MKIAPMNKDKGGEKILDYSILNHKGFNSFEEKIKRIKVHKPYDKILKTSFKKNPNGFLEILEKGAIFEEFVDSEIINAFFRELHSDIIIRVYKKRIYIIEFQSSRLKLEDILRFGLYRASIAHQEKKDIHLYVVSKEPIKRDKIENKYGDYWFTIHVKSLTDMDYNKALNRTNNKIENEEEEFTEEDFVYLEISPLMTRKKKKQRQLLKRVAEMTNKLDGRISREKLIEIKSIQFVLATELLNDNEKAKIAKVISMQSEGKEEVFQGYLTKEERKQTYEEGREEEREEIVKSLAELDVSPDIIAKATKMSKAEIATLTTTII

SEQ ID NO: 6324 - protein, 169 aa, Methanobrevibacter ruminantium
MEYRLPRMEDEDDIRDFIRECCYVEECYVMLKQELLLSDYSKWVSLIHRYASLGNGKWGRSLLLLAYDGSRLVGILPIRYEISEDYAFLYGNIGYHVRPSLRNMGYATKMLKHGLEICKEKGMARVIVGCDRDNLASSAVIKKCGGVRLRTFNDSYGVNDYYGIYLSSE

SEQ ID NO: 6325 - protein, 217 aa, Methanobrevibacter ruminantium
MKTTSVIVLLVILGYGLKVTQDVINGGTSLPKISLKELLNFGVKGTIVYTFYLTIQASLLGLISLAMNFPEFELEEMILNLHETIELFFEHDPISFILFIILGLLIVYGTIFFMEIALAILADGETLKAAFDFKRIKRTVETIGWKEYAEDYTKIVAAVVILVFINGYFHSYGWISIIIGVLTDILAFTVEYRGIGNIYRGYKQKINQETALEDTSN

SEQ ID NO: 6326 - protein, 468 aa, Methanobrevibacter ruminantium
MKKTKIIASVGPASDSVEVMSDMVEMGMDCARINLSHANQEDILKIIDVVNEVRKICNVPLAIMYDTKGPEFRTSEFKHGGVLLNEGDTIKMSKTCIQGNKEEFGVNHKEAIDFINVGDKVLIDNALLEFEVIDKKEDYVLLKALGDGKILNHKTINVPGVDLKLDFISDVDKEDISFAAGHSCDYLALSFVNSGEDVIAARKIVEDAGGDALIISKIESRMGLMNLDEIIDESDGIMVARGDLGVEVPMEHLPIIQKDIIRKCREKGKFAIVATEMLASMYESPRPTRAEVSDVANAVLDGTDCVMLSGETTIGKHPVHAVEMMDRICNYVESTIDYSKHTFYKGKVAISDTIAKLVIGASEYSDIKLIVTPTLTGFTARKISNLRSSSAILACCPSNDIARKLVLNFGVKAVITDIYENTDEMIDNVVDIAKMEFDLNKGDLIVVTGGFPLGKTRNTNSLRILEID

SEQ ID NO: 6327 - protein, 496 aa, Methanobrevibacter ruminantium
MANENEWGSNLAFVLAMIGSAVGLGNIWRYPYVLYSNGGGAFYIPYLIAILVLAIPLIILEYGVVYNYKSSFTKAIVKIKPKLEFYGWILPVVTFIMTIYYSTILGWDGIYFILSFFKGWGSDPNTFLTVSLLQSADSISGILNFIPVIAISMIFIWLIIWFISHRNLDEGLGRVARYFVPMLFVIMIVIVAFSLTLPGASIGLAELFDPDWSLLYNYSIWMAAFGQIFFSLSLGMGAGFTFASYTKRDIDLISSGLCVVLANSLFENFAALGVFSILGYMSLESGVAVSKLVSQGTTLIFVAYPKVFNILGGVALILGPLFFFTVYVAGVTSILSSFEVLSISIQDKFAFSRKKATTALCIVGGLASMVFATSAGGYLLSIADIFVNNIMVLFSVIVQTILFAWVFKAERLVDFFNAKSRFLKLGRWWLILVKYICPILLTVIWIGELYNLIKMGSTEFVVILGVLLAILLIFAFIFTIRPAKTDEWFKTEERIK

SEQ ID NO: 6328 - protein, 205 aa, Methanobrevibacter ruminantium
MGEEELIDQYMKPHGEEGIKIIESMNEEHQNISEFAFECVNLGAYDDIIDIGCGGGVNIEKFLNVTNGHVDGLDYSDVSVSESIKRNQTSVDGGRCNVILGDVTDMPIGDESYDLATAFSTIFFWPNLVETFKEVKRIIKPNGQFMIAQGTDGTNPEDQEWIDTIAGINVYTANELEEYLLDAGFKRVDVFTKENTYLLVVIGKK

SEQ ID NO: 6329 - protein, 165 aa, Methanobrevibacter ruminantium
MDFNKEKFKMVLQYIIYKCGIKNTVGRTVLHKLLYFSDFNYFELYNKSLTNECYRKLARGPVPVHFESVVEELIDEKKISLKNRRLPCGKLMNRYFSLEKPEIDLKEDELAVIDEVIKDLSHMNGKMIGEYSLKDMPVKQAHDNGSIDYNLVFSRSLQYSKRTDD

SEQ ID NO: 6330 - protein, 40 aa, Methanobrevibacter ruminantium
MAKINYSYSKKYCIIVFIMMFFMKRNYSKKNYKIGKTDIL

SEQ ID NO: 6331 - protein, 112 aa, Methanobrevibacter ruminantium
MKDLIGFCGLDCELCQAYIATINDDDELREEVAKHWSELNNVEISPEMINCMGCRVEGVKTPFCDFMCPIRQCALENNYDTCADCDKMEGCEKLVMIFENNDNAYKNLKHHY

SEQ ID NO: 6332 - protein, 182 aa, Methanobrevibacter ruminantium
MSRRFAVIDTETNWNDEVMSIGVLIARCKNFKRTDSRHYILPKAEAVGGMYSKSMRVTSHEILTKHRNDAIDDLRYLLDSNGVDDLFAYNASFDNRHLPELSDFCWRDIMKVAAYKQHNPSIPNHMPCFKTGRLRRGYGVEPMLQILGIEDYCESHNAIIDARDELKIMELLGYDIDFYPEI

SEQ ID NO: 6333 - protein, 202 aa, Methanobrevibacter ruminantium
MTVIMSTNTMGYADLDLRPAEMQRSTMYISINECPNCGYAEFDFSREPKIKREYLESEEYQSCEGIEFKSERSKPFYKAYLINRKEENTQNELNFLMHSIWSCDDSEDCENARKLRRIACQLLETILSNIEKHKEWADKDTLMLMKSDLMRRGEMFDELIEEYETVSFEDTLLNNINQFQIKKSKEKDSARYTIGTVISLYG

SEQ ID NO: 6334 - protein, 208 aa, Methanobrevibacter ruminantium
MNTKEKIFDVSLDLFSKRGYDSVSLREIAEEVGIKKSSIYSHYSSKEAILMDIFEYFTDLFEYDDLINSKELVLSEDNDVLIENPELFYHMGSEAIRGMFKEERNLKIWKLIFIQMHYNEKIRNFFQKEMLLKPLIFWENFFAILKEKGIIRADSNPQLLAKEYYSFPIFLLLEICAKYDDIPESCLDDFFKQAEEHARFLLDCVKVK

SEQ ID NO: 6335 - protein, 363 aa, Methanobrevibacter ruminantium
MDSKFNIQEYLANGVEVILKDAFKATLKNPKEGLYLAKFAKHARKASEIRREYSKKGQNIPVFLIASITSSCNLHCVGCYSRANNSCSDEAPLNQLSADDWEDIFKQARDIGISFIVLAGGEPMIREDVIKKASKFPEILFPIFTNGTMLNEDYLKLLDKNRNLVPILSIEGDEKLTDSRRGSGVYKQLMDSMETMKKKNIVFGASLTFTKGNISSLLSRDYIEKLHDLGCKVVFFIEYVPVNEETVDLAPSDSERELLLSELDELRSDYSDMLFLSFPGDEKESGGCLAAGRGFFHINSHGGAEPCPASPYSDINVCETSLLEALESNLFRSLRDGGLLLDDHEGGCVLFEHKEEVESLFDN

SEQ ID NO: 6336 - protein, 137 aa, Methanobrevibacter ruminantium
MSFTDNLKKSLGFEEGEYGSGYTFDEGYNGEPDPFFEGILIPYKFPETKAFMEIILIKPKSVDDMDYIFDQVVEENNPVIMDLSFMEKKGAAEFKQAGEKLKVLRQQYNAEAILLSKSDDKNLIIVTPARVKLIRKE

SEQ ID NO: 6337 - protein, 251 aa, Methanobrevibacter ruminantium
MIDTHMHADARSSEDFEKMFIGGIDTAISCSYYPYKVNNAEILLNHLNRILNFEPKRAMEYGLELKIALGIHPANSIKDNEIIFDSLKEWIDNKDIIAIGEIGLDENTELEKEVFKKQLELAEETKSKVIVHTPRKNKLEVLKDIKEIALENINPKLVVIDHINLNTIEEIIDDDFTIGLTVQPQKMEVEEAIEILDKYDFDKFLLNSDISNKPSDPLSVPKTVRTLKRLGYKQDKIDKVAFKNAESFFNL

SEQ ID NO: 6338 - protein, 270 aa, Methanobrevibacter ruminantium
MYYHDYVKEQLRFLNNSEIRLRILAYLSKKPFSLADFKNSSFVSYSSISSNVYKLTDEGFVEKIDKNNFRLTNIGKIYLISLMEFHDTINTVNNFSDFWLDHDVRALSSKYLKRISQLEGSKLIQSRPTDIYKTHEEFRNLFKDSDILKVIFPYLHPEYPRLIRTLLSNGSKIEILVPRVICRRFIKSVGESLVRSSIKQNALSIKFIDDEVKLALAISNKWVSIGLFKRDGSYDQSRLLVSDKKDAIKWAYNIFKSYDKKAELVDLRSL

SEQ ID NO: 6339 - protein, 272 aa, Methanobrevibacter ruminantium
MIGDINFELDSENFRIMRFLLSSFMRTDLLLTLVNSSSRLCSLRSNLGKSSATILHGVSELEAFNLISKDSKYYCLSSKGFIYGLALDKLCKNLYIFQSNPEFWQNHFIDGLPSEFVENAYLIKDSVYICSDKLDMEKPIRDYFKNIKNSKSIKIILPIFSELYLEMILKTVGSDHDLELIVDEEVFTSIKKSRYYRRIIRLSKGGKIILRKYIGDLNLFLTFSDEFMSLNLFDKDGFFDDSETIFNNTPDGVKWAEIMFDYFLDNSNVVVL

SEQ ID NO: 6340 - protein, 570 aa, Methanobrevibacter ruminantium
MNHEKMSNIARKRGFLWPSFEIYSGVSGFTDYGPLGASLKNNIMQKWRKQYIAGEGFHEIEGPTVMPKEVLKASGHVDNFTDPMTKCKDCGEVFRADHIIEEAIGEDVESLENEEMDEIVRKNDIKCPSCGGELANIWNYNLMFKTEIGAKGDKVGYMRPETAQGIFILFKRLSRFFKNKLPFGAVQLGKAYRNEISPRQGVIRLREFTQAEAEIFLDPRDKTHPKFSQIADEILYLSSQDVQINNKETLEITAQEALDQGVVSSETLIYQLYLARKFLKELGIPDEVLRFRQHLPGEMAHYALDCWDVECLTDQYGWVEIIGIADRGDYDLKAHTEFSNEELSIYIEYDEPKLVKKTIVKPNLKLFGPAFKGDSPKIKTYIENLSDEEVIELKEKIESKGKFTLELDQSFEILKEHLLFEDIEEEVKGERIIPHVIEPSFGIDRILYCTLLHSFKTEEDGFDKEYFKFANEIAPIQVSVFPLMNRDGLGEIATEITHNLREAGFTVDNDTSGTIGKRYARADEVGVPIAITVDYDTKEDDTVTVRNRDTEEQERVKIEDLKEVIETKYL

SEQ ID NO: 6341 - protein, 195 aa, Methanobrevibacter ruminantium
MAILSDRDIKKYLNEGKITIDPLEDEKQIQPSSVDMRLGDEFKVFKVIRKPFIDPKDPEDLASYMESTIVPEGDAFIIHPNEFALATTYEYVKIPDDLVARVEGRSSMGRLGVTMHVTAGFIDPGFEGRITLEISNIGAMPVALYPGQRVCQLVFETMTSPSELPYGHPERNSKYMRQRRPESSRIKFDYELNEK

SEQ ID NO: 6342 - protein, 291 aa, Methanobrevibacter ruminantium
MRKGFYEDISTFLVKHTFHTRFFLSRLTKKSKIAKKIIDRLLFQGDEVYVLPNKNTVQKTKSATISANIEVNQSFQKDDSEFVPSEILKIAIREASDIVIMNKCLCRSSNDCQDYPQDLGCIFLGPASRKIASKYGRRATVEEALAHVDKADAEGLSHVIGRNKIDTIWMHVSPKEELLTICHCCPCCCLWKVLPDLDNDISDKIMRLEDVEVHPISDNCKMCKKCLGDDICFGGAISLENDKITIDQNKCVGCGHCVQTCKFNAIELNYTQKSVDSVLNRIGELVDYKKH

SEQ ID NO: 6343 - protein, 263 aa, Methanobrevibacter ruminantium
MKYKDKKSERGKVKEIVEDEETIRLKENIYVVFVECESPGNVGFLARTMGNFGLNKLVLINPCTLKEEAYYQATHARDTVENAMIYDTVGEFVKDKKIDFIIGSTGAPGGSYNISRIPLKPEELAKSMNYNDKIAILFGREGNGLTNAEVDMCDLIVSIPTDPSYPIMNISHAAAIILYEIFKNRNEFPVQGLEESTAIEKEYLIKDMEELIDNLNIPEHKKKNGLKVFKNIVNRAFITGREAHTLIGILRRLNLKIKHGDEY

SEQ ID NO: 6344 - protein, 508 aa, Methanobrevibacter ruminantium
MITVYVKRFDSEKDEEPHIEAYEIEESPGMKVLDALEEINRKYNADISFRSSCKAGQCGSCGVKINGNGALACKAQIKDNRLIEPLDFPVIKDLVVDRSSADEKVKQLQLSLNCDDETAHEKLNPKDIKDTKKVRSCIECYTCLSTCPVVKHFKEDFLGPYYLRYLSKFDFDPRDESDRLIEALDSGMYNCTSCGKCGSICPKSINSFGDAIEKLRAMAYARDLGPLDAHKMFRENVVASGRSVSKPEEPFIETIHKKWDEEGKYYTDDESNDENKNKEKVALFTGCMVDYRAQEVGYALIDVLKANNIEIDIPEGQVCCGSPLLRTGQVDAVQELVDKNKEVFKDYDKVITICAGCGATLKNDHPKYGSNLNVEDISEFLVDKLDTSKMKPLNTKVTWHDPCHLSRGQNIKDQPRDIIEMIPGVEFEELELPCQCCGAGGGIKSGRPDIALELAKDKAEMVRVTGADYVTTICPFCQINLQDGLNAIGLDNVKTLNLIQLLKMAYDE

SEQ ID NO: 6345 - protein, 663 aa, Methanobrevibacter ruminantium
MAYDQLVTSEKGDKLFLLGNEAAVRGAIEAGVSVAATYPGTPSSEIGNILSVVAKSADMYFEFSANEKVAMEVAATAAASGLRSFTFMKHVGLNVAADSFMTTAYSGVKGGMIILVADDPSLFSSQNEQDTRNYSRLSSIPILEPSNPQEIKDMMVYGFDLSEQFGIPVILRTSTRVSHMRGIVEMGEINSPKSTTKEVKSDKHWLKGYFVKNPREFVPVPANALAMHERLVEKIGKIEDEANESPVNEVVSFESGVLQGKYGVISSGGAFNYAYDIVAGENLGMDILKIALSYPTPKDLIYDFCKNLEGVFIVEEVDPILEKDVLAVLGEKNLDCPVYGKIDGTFPMVHEFNPDIVKESFNKVISDLADDEELKAEYKDEFGKDLTGDLIETVEKMEFSQSLNDLVDNIPTRAPTLCAGCSHRSAYFASVKAYEELGYDKEDMIFASDIGCYTLGISPPYETADYLLAMGSSVGDGCGFSIATNQHVMSFIGDSTFFHSGLSPLVNAVHNKNKFVLTILDNRITAMTGGQPNPGIPIDGMGDEAPAISIEDIVEAIGVKFLKIVNPHNIKKTVDIYKEALEYDGVAVVIARYPCTLIKGQKRKPVMEIKDSCVKCLHCVEKLACPAISYLDDKVTVDEALCKGCTVCIQICPNKAIGVKKGD

SEQ ID NO: 6346 - protein, 212 aa, Methanobrevibacter ruminantium
MDNINSSSSNSDNSDVNYSIYISGVGGQGIIKTSVIIGEAAMLEGYDVVMSEIHGMSQRGGSVSTELKIGNFKSSIVEENKADLILAFEPIEVLRGLDKANKDTALIFNTFPIVPSTLTQTGETYPDIGDIIKNLKDNFDSVYPVEGNGLAKDAGSILSLNMVLLGACVANDSFPLSKETVETAMKHNLAPKFHEMNLKAIENGYNAIKDSL

SEQ ID NO: 6347 - protein, 196 aa, Methanobrevibacter ruminantium
MNGGVKIESTDIRYFYRNIVKSGKKYRIKHNNKDYGEFSKLSDALYERDCLFYCKFDYDLLVECDLPNKYENMELPPFPEHRPRGQIKGLKFNKKEREGEIVFDHKERKFCVIRGEEHFGKYNTMVEAYYVKKILMENDWDKACLIQNKRIREDIFLNQKIKASTPKLNKYCPNCGNKVKEEDIICKICGIRLVKD

SEQ ID NO: 6348 - protein, 91 aa, Methanobrevibacter ruminantium
MYEDKLYDKAERRVDEKIKFYRHLYSYIAVNVILAVINLIFFKGDWWFLWVSLFWGIGLVSHFIKTFVIFNYFDDHHRDSMIENEMAKMRK

SEQ ID NO: 6349 - protein, 153 aa, Methanobrevibacter ruminantium
MKVQLFVSKDLEEPYAEIYTDNLTDNIQKAMVLLENDESDDDVDEGNSILAVKKGSDIVLLDFEDIFMIKVEDKQTKVFSQNAEYSIKKPLYQIEESLDSDFVRISKSTIVNLRKIKRVAPSLRGMMFIELKNGLKDNISRKYLTDFKKALDL

SEQ ID NO: 6350 - protein, 143 aa, Methanobrevibacter ruminantium
MEIIKRIGIGAFVGCFVVMLVMVLGTYSLGPQNVSFSGTEIINAFFGSIVVGWAFAFSGLIYEKEDIPLPIQVIFQMVIGLGTLFAVAVYLGWMPISLGIGPIITWIVIAIAFAAVFWLGFYLYYTFLARDINKKIELSNDFD

SEQ ID NO: 6351 - protein, 379 aa, Methanobrevibacter ruminantium
MKTIVNGLILKGLELEAKKENILIDDDGTILEISKEVKEGEIIDADNKIVCPRFLNAHTHIGDSIIKDEGEGLSLDEVVKPPHGIKHVALESADDDVLIEAMRESMWDMYNMGVSHFIDYREGGLDGVKLLKEAAKDIPITPIILARDSSFYGEDANYHMVKMALKKLLKESDGIGLSGFGEISTTVAEIICERCEREDKISSIHVAENELNQIASLEKTGKSEPQRAFEAGFNQIVHMTNPKNDDVELLARSDSSLTVCPRSNGALAVGVVPLYEILNKGVRPLIGTDNIMINSPNMFRELEFTLKIMKGVSRNHIDAREILKMATTNADSSISNLPIDKSYIGEGQKAELMIVNKKSNNPYLSLINRTEANDIVKII

SEQ ID NO: 6352 - protein, 291 aa, Methanobrevibacter ruminantium
MIVKDVASTDVIHVTVPGSRDEALRIMKKEDVSVVPVIKKETGKLVGILTRSDMITNPDEEQIAMLMTRNLITAKMDDELSTVAEKMVTNDIRRVPVINDDDELVGIVTSFDIVSLAIADMGIKDPVENYMIKTIPSTWDETPLNVAFEVMKFFGLKSVIGLNSNNKMTGILTETDFIAESEIISERTEHSSSVGTEGDKWSWDSTSVLYIEKNHLKFTDKVFKDVASGDVVTANTKTKVSVCTEKMKSLDVEQLPVLGIEGELVGLVRASDLIKSFIIGFNFSFSFIFTF

SEQ ID NO: 6353 - protein, 359 aa, Methanobrevibacter ruminantium
MKANPKIEKVKQILKDYKKIALAFSAGADSTLLAYLAKESDCDVLAITYDNQIFPEGFLEFAKRRADELGIKHEIIENSFLMIYDVAHNTPQRCLTCRRLMYGSIKQVANERGYDIIIDGNNITDLIHDRPGILMKYANGIESPLIDANLESYEIHDFLEENDIEYSKSTTCLATRVKANETVTEDKVNRIDYCEGFIKSTIGADVVKLREEKNIATIELGNNDSKKILDKEKLEIIFNELKEAQYDKILLNIDFTEDEEELILDSELQKGKENLILRKKLPFDIEISKTGKVINEADNEFISDIQTIEEIGYIKLKIDKKESKIFRDGKISIENNKNKEDAKESLVKILPLIRRAKPF

SEQ ID NO: 6354 - protein, 213 aa, Methanobrevibacter ruminantium
MTKIIVYLGLSIQEEEAKTILDADYRTPVKRGDILKAISEKPDIIGIIDGVFHHTPAVAHKEIMKALKMGITVVGASSMGALRASELDDLGMIGIGYVYKAYRSGKITSDDDVALSFDPERNVPISEALVNIDYKLDLAVKEEIISEEDKEYIHNIAKDIYYPKRSYQYIFSKVEMEDEKKTKLIDFILKEKDIKYLDAIEALEYIKSISEEE

SEQ ID NO: 6355 - protein, 419 aa, Methanobrevibacter ruminantium
MFEDVEIQFFKGTHRVRDPKETIEINENKLRTAGITRLTEITDLDRIKIPVFSAIRPTAQEGGVSVYAGKGATKEQAKASAMMEGFERYSAERQDIDNERTFVDTYNNIKSSQELKALDPRDLLLPKNFTTQNVENSRLEWIESKDIISEETIYVPSNAVFHPYIPTREVIPSPLAIFKGNTNGLASGNIIEESVLHGIFEVVERDAWSLFELTKRNKKEINQDTIENDIINELLAKFNNEGINIKLMDITADLKITTVAASADDTVLKDPALLTLGVGTHLDPNIAVIRALTEVAQSRATQIHGTREDTIRADFMRKSSYEGMKRMNKHYFQKEEDTIDLSDIEDKSSHSIKKDIETSIEEVQKVGFDKVLYTDLTREEIGINVARVIIPKAELYSLDEERLGTRALEYDRKARRGLV

SEQ ID NO: 6356 - protein, 347 aa, Methanobrevibacter ruminantium
MVSSENKVHDFHIKNILKRLEEKDLDAMMVANFNNIYYLSGYLSTSFAFMIVKENPIIFVSGMDLENANNNSSIDIIKYESADQMVEYLNEEEIKDLAIESDLTANAYQKFKDFNLTISPAISIERMIKTDDEIDKIFKAGEIAHKSLLELDVRSKQEKGAEEWECAYELGYLMRKNGASTESFDTIFASGPVSSLPHSTPRHHKLDTPVLVDYGCKFEGYCSDTTRTFVYNEKQEEISKIVLEAHDKAIKAVKEGVKSCEVDKVARDIITEYGYGDKFIHSTGHSFGLDIHESPSLSLKDETILEKNMFVTIEPGIYLEGEFGVRIEDMVLVDKKAKIVGNLPPIL

SEQ ID NO: 6357 - protein, 74 aa, Methanobrevibacter ruminantium
MFSIYLKNDFNRLFKEDKAQGSVELILLIGGIIVIVLVCMFVYKSYMGGLGDELESNELESLNNSFEELSSKFE

SEQ ID NO: 6358 - protein, 471 aa, Methanobrevibacter ruminantium
MKVLIDGEDFDSGDHYEVKNPYDGELVDTVPICFRQDVDRAIDAANRAKKELQDMSAKEVSNNLYSAYEELESRSEELAKLIVLEAGKPIKQAIGELNRSCETLKFAAEEAKRIYGESVPIDATGSVDERFLAFTKKVPLGVVGAITPFNYPVNLALHKIAPAIAAKNAVVVKPSTEAPLAALKLVEIIDNHFPNGVINSVTGYGSEVGDALVVSEGIDKISFTGSIATGLFISSRAGMKKLTLELGGNDPLVVLEDADIEKAVSAAVSGAFLFSGQVCIGVKRIILDNKIADEFIDLFVKEASKLKMGNPMDESTDIGPLINENASINVETAVNNAIKDGAELILGGNRKDCFYEPTILDGVNMSMDLVANETFGPVAPIIRVDRIDEAIKVANDTRYGLQAGVFTENVHSALRCANEIDAGSVLINKESTFRTDAMPFGGFKSSGMGKEGIKYAVEDMCKFKLIAFNCR

SEQ ID NO: 6359 - protein, 241 aa, Methanobrevibacter ruminantium
MWDTAKDYRILVAMHARELFLRTVQTGSFRGNWNKKATIEETKKMEADLKSLLYCYLEGDALANCEDVQKLEDKAGRIIEFLGGEDWNHKFMQGAPKDEREKTEENIAKVRFFLDTILGLRNRFKFGPIDDPIMGIDVKVGEIMSVSKHPKADSLMICNVNIGKRALKVVTNDLTVKEGNRVGVSLLPPATFMDVVSEGMFLGMNGSILKEVQGDLGNMPNGIPMESLNETKNMITAFLDS

SEQ ID NO: 6360 - protein, 138 aa, Methanobrevibacter ruminantium
MVEVTQLYDLDIYTLAGQYVGQVHDVVLNIRYGTISRLQVKALEPEKKSAGFRDIFRGGFQFVPEEEVGRTYQEGLLNIEFDRVTAIGDIMLIDPQDLKRPKPPVAGEEMSIRPRPEAPKQVPQEVPQEVAPKPKEVI

SEQ ID NO: 6361 - protein, 253 aa, Methanobrevibacter ruminantium
MIVGILGCGAIANTIVNEFLSDDGIDIKYFYDTDIERAENLAQISNGIAVLEMDEMLDNVDLVLESASPIALKVHALNIIENGKDLMVMSVGALMDKEFRQKIHKAAQANNAKVYAPSGAIVGLDGIKAASIGKIKKASLTTRKSPKSLGREVEEEEILFEGKASEAVERFPVNINVAASLSIACNMDIDVKIIVDPKVDRNVHEVLVQGDFGEFRSSSENVPFAANPKTSMLAAFSAIKLLKSFSECFSVGT

SEQ ID NO: 6362 - protein, 252 aa, Methanobrevibacter ruminantium
MKDYEIYSNLKVPKNSNIILRLDGRKFHSLAKYLALKKPYDNNFAKLMSEVSLDIFNQFSPKFIYTFSDEISILLDEIPFLGRVEKLNSVFSSIASSSFTYHLLNDFKDDFNMDKLDEDDRNVIFPVSFDSRVIPIVNEDIYDYFKWRQDEAWRNCVNAYGIWALKKEFSPQIANEKIKGLKSSEIHELLFKKGINLNDVDTWKKRGIGIYKIENQIEGFNPVKEEKTVSYRSEVFVDYELELFNKEYFYRF

SEQ ID NO: 6363 - protein, 306 aa, Methanobrevibacter ruminantium
MGFKDLISKLNEKNHFEKVCIDQTVIDSIIYYSKKSYPDEFLAMFDGFVKNEVLYISGLIFLGGERSHTSASFNDWLLPPDQKKWGTVHSHPGLNARPSGADLTTFSKYGSFHIILCEPYSLETMMAYDSYGNMRGFEVGNFVDGKDDEIYKDLEELRKEIEEEDGELTPSIFDLDQDLSFFDSEEVKTNKYSHELEDEFGNLALDNDGSNDFDSNNFSEDINSNNPNSNDFTSNRFYPSRNVSDEDLGSIDLNPQVIRIGGEKVNGQSPKLGIIIEFRDGKPILKSYTVDSQENEDSQEKEDSDK

SEQ ID NO: 6364 - protein, 524 aa, Methanobrevibacter ruminantium
MKALVADAINEKGIENLKEVCDVVVDTSITPEELLETIGEYDAILIRSRTKLPAEVIEKADNLKIIARAGVGVDNVDVNAATKKGIMVVNAPESTSITVAEHTMGLILSTIRKIAIADKSTKAGKWEKKAFMGMELRNKTLGVIGMGRIGSQVVNRCKAFEMDAIAYDPYLPPEVAKNMGVELYEDIEDVLTRADIITIHVPLTPETEHSISTEQFKMMKDTALIFNCARGGVIDEDALYEALVNGEILGAGLDVYEKEPATNNKLFELDNIVCTPHIAASTKEAQRDAAIIVANEVITLFKGGMPKNIINMPRMNNSEFEETNDYLELCEKLGSFITQATSSPINKLEITYKGEINKLPSKDLFTRTILQGILNPVTETAVNAVNATTVAKARGISITEAVSDDSEGYDTLIKVAAKTKEGQMSAEGTYLHEAKIIKVNGYWVDVKPEGNMFIAKYKDIPGSIGAIGTKFGEENINIGIMQVGRDSTGGEAIMILTLDERPSKEAVKKIKDLDNVSDATCLKL

SEQ ID NO: 6365 - protein, 112 aa, Methanobrevibacter ruminantium
MVKFEEFPISSANYIPGYKVVEEKGFVYGLTVRARGLGGDIGAGLKGILGGEIKQYVKMMEESREESIGRCIEHAKELGANAIISVRLDSDSISQNMQEVLAYGTAVVIEKE

SEQ ID NO: 6366 - protein, 257 aa, Methanobrevibacter ruminantium
MVLGNAPFLADAYFGHRTRLYNLDLLRNPNNVSKIIEKSYDCGVRSINLANKENLLKAFGMACDNGVEMQAVSTIGKTEMDYVIPDYDEARREATWKEDIENLAQFDNSIMLVDEFLIDSYDWDFITDILDAINDTGIPSGIITSFPFKTSLELIDSPLLEDKNLFDFYMIPVNKLGYMMDVPHFKSDKQEELKLMLDKIDKKIIINKILAVGIQRPEEAFNFLNTLDFADMVSVGIASEREAEETFGIFKQNLDFF

SEQ ID NO: 6367 - protein, 269 aa, Methanobrevibacter ruminantium
MDYLKKIPAIRWKDGKYEEVEEKTVSDENIYFYIDLLPPRKFSTYPADLEDFGVGYCLGDGLVNSYDDILSIDIDGKHITIKTKFNHGADEDNKEADEEKPDVDADVLGYQSVMSDSAGGWRSELKKIEPIESDLVVNASEIIENMKRLTAKAEIWQATGSVHVAQLVYGDKFITREDVSRHVAVDKVIGAAAKAGFDLSKCYVTYSGRMPADMVIKMVRVGVPILVSNAAPAGSGYEVAVKGNITLVGFVRSNRFNVYASTSRIDLDK

SEQ ID NO: 6368 - protein, 143 aa, Methanobrevibacter ruminantium
MSDENKDNRVYNLLITKGTDPEGQYEFYKERIDSQKDFLYAEYNTQDNELNDDLFEEVDVIVLLYGLYHDNTEICDELIKKSKELSIPFLLVRSFGVEWILQDLESKADAVVGWNGHCIVDAIKTLVDGGGEWIKPCDIEEEY

SEQ ID NO: 6369 - protein, 55 aa, Methanobrevibacter ruminantium
MELNSKHYTIILIIAIIIAVIMTYMTGIKNPIIIGLCILAIIVILANLYLTKLKK

SEQ ID NO: 6370 - protein, 326 aa, Methanobrevibacter ruminantium
MAVTNRNQLIREVYQLLNKEGFETSNIYDQSCFDIVARKKLLILLLKILVNIDSINESHVEEIRQISNVFLASPIIVGLKSKNHILEEDVVYERHGLPAIGLQTLKNMIIYDEYPEILADRGGYYVQINGNVLKEYREEYNLSLKDLADLAHVSRATMYKYENGMVRANTETAMLLEEILNTKITLDIDLFEPYQEDIKLKADTSNLNQTQGTNAQNLAKLGFGVVSTNKSPFDALAKAEIATKKKDNPLIANLNVQDEQNTKTLKKMAISLKDLSLVTSSDPFFVLADDKIKDSIDGIPVIKSWEMKEFENSKEFLKLIKERRNN

SEQ ID NO: 6371 - protein, 430 aa, Methanobrevibacter ruminantium
MEILYFYSSSVIIMDYFYIGIDDTDSPDGMCTTFLASSILNEFERSNIKIIDYPRLIRLNPFARFKTRGNGGVSFKLDIDEDTDLAKEIVLGYVRELSMFDCDNTNPGVVFYEGEITEEMVDYAFKAIYSIITIEEAEEFANHIGAEIYKFKKGRGIIGSIAAISCPLEDYTYELLAYREPSRYGTLRNIDYDSVVRMDKETYPETFENIDGKYLAIEPKTPCPVLYGIRSNSPEVLEKAREMVIPNETIADSCIFKTNQHTDMHIQNADRISDMKQYSCYRIRGTVKERPHIIEGGHMFFTLYDDSGEIECGAYEPTKDFRKIVAKLREGDVIELYGGIGEQNTFNIEKFQVIKLNEFVYRNPVCGCGKRMSSAGRGKGFKCKSCGKRIESDEKVPEKIDRTLINGKFYETPVSARRHLSKPLIRMDLD

SEQ ID NO: 6372 - protein, 477 aa, Methanobrevibacter ruminantium
MIIHELSRFLIDLKYDDIPKESIEKAKLCFLDYLSVYFRGLESENSKIAIKTIYKLFGDNFNSLNKAFINGIASHSLDLDDGHRLAQLHPGSIVFSSLLALISDKSLDLDISTEKFIESIVAGYEVAIALGILVNPNHRNQGFHSTGTIGTIAAGAVASKILNLNLEQTEHCLGLCTTQSAGLLEADHAGTMGKSFHVGNACYGGIISAFLAKNGFTGGESIIDGKEGFLKAMSLKTYEDYLDADNNDLDYLRISKFLEDNLGKFHINEVYLKKFPFCRHIHSSIDSTLYLKESIVNSDDFDSLDSIGLDSIDSIEVKTYKIASEHDNFNPKNPQDLKQSLPYAVAISLVLNDLSLDSIDELKDDGLFDEKSNKEYVLKIKEIISKINIIYDKDLDDLAPQMRPSQVTIKFKDNSRDSIKHTVYYPLGEVENPLSEEDILEKFKLLNPKFNIDKLQIIKHMEEYSIDELFRELDLID

SEQ ID NO: 6373 - protein, 291 aa, Methanobrevibacter ruminantium
MDETKNSLKELGINELHDDYVSQKRFEDGGQYRFEVPGIQGPSALESLLNACDDFDLTIHRATQTKGIMFLLDEEIEDMVDLADDANIQLFLAVGPRAPYDTSATVQTEEGKRIGYRLRGYKNLVYAIEDVKRAVGLGVRGILLYDEGLLFALSKMRENGELPSDLKFKLSAHAGCSNPASAKLFESIGLNSLNPVRDLQIPMLASLRDAIDIPIDVHTENPKSTGGFIRHYEVPEMIKVASPIYLKTGGSVAKHHSWDTTDQEARQRAKQVALIRDLIERFYPEAQMSKL

SEQ ID NO: 6374 - protein, 294 aa, Methanobrevibacter ruminantium
MDLIKKVEDAVVKAGSGYSEDRLTAYENALRLEEEKGNENAVWALEQMIENFKVAKENKLPLCDDTGIPHIIIEIGYNREIPKNFFNDINAGIANGLDKLPGRPMAVKGNDIERIEQSKGLYAESNMMKPASFLIEEKDDSTYGRKIGIDDDKIRINVLLEGGGPEIRAKTYRVFHKRDSNIVFNEALSWLKESLSMLGCTPSIPAIGIGRSHFEANSLMLRAMVHGNLNDQSDIEKYIADELNKTNIGPLGLGGVTTVLGSFVNIGYQRASGVRIVAVRPACFVEPRVSSFEF

SEQ ID NO: 6375 - protein, 282 aa, Methanobrevibacter ruminantium
MSDDQKPYKNGFKFPEQSIRTKITEVSPNRLSTRGFNQEDLIENLSYSENVFLILRGRLPDEKEAKIFNHILVSFCDHGVTPPSTQSARLIASSGASINNAVAGGLLSFGKNHAGAIEKAMALFQESISGLNLEETDPDDENKRIALLAIEIVNRYEGESKRVPGFGHRYHDKDPRAAKLIDLAIQESAIGPHTKLALAIESILNEKKGICLNVDGANAGLLSDLGFDSDLGLGIFMIGRLPGLIAHAFEEMQEEEKFRRFCDLENIVYEGFKNKRIDDGEE

SEQ ID NO: 6376 - protein, 169 aa, Methanobrevibacter ruminantium
MEFFDVIEKRYSMRGFEDKEVEQEKLDKILKAAQIAPTGVNFQPFKVIVIDTKKYKEELNAIYPPEWFTQAPIALCVVASKERAWTRKFDGKNIADIDATIVMTHMILAAEDLGLNTCFIAAFKPDEAKKFLALDDEWEPVLFTPLGYGNAEPRDTPRKAIEELVIYKD

SEQ ID NO: 6377 - protein, 104 aa, Methanobrevibacter ruminantium
MAGISEAITQIKKAESDADSLVEQSTVDAKAMIDEAHVKANEMVEAAKNEANEEAQSTVFDAEENAKKEATSISSQADSDVEAIKNKARNNIDEAASIIVKNIL

SEQ ID NO: 6378 - protein, 668 aa, Methanobrevibacter ruminantium
MFRTARMRKLNVITLDKYAGPTVSALHDEGIVQINDISERIQQDPKLAELLKPSKVTPYTGKLSSLLMKTSALSDLLGDALSEGQSLKDTLMSFISPDLPVPKEVEDVDTESFIAYAESTLSQVEAETKGIEDKLAALDSEESKLESNKSLASKLKNLDMDLALLSDSKYTSTIVGRITAESAQKFKSEYSKITEDLFYELVPDDEKEYNILVVVVANEFKDDIYTLLRKNEFEKFETEDLQGRPDSLISSCESRLQAIESERSQAKADLKVVAEKWDDEVLALKEQLENEKEKNEVFATFAETDKTVVLEAWVPEKNLEQAQSIIETATDGHVIMETEEVPDNAEDVPVLQENCTYAKPYELLVEMYSPLKYNEIDPTLFVAITYPFFFGFCLTDAGYGILVALIGFILYRGMGKVNRTMHDGGLIIIASGIWSIILGLFTNGFLGDMWTRILGLGPALPTVIDSINAFKFPATILVIAIVIGIIYTNIGFILGAIDNLRYGEKKEAIGSQIVWFVFELGIILLILGFLFPTFGMIGMALGAVLIIAALGMLIWANGAYGLMDVFGFMGDVLSYARLLALCLATGGIAMTVNILTNMVNDMIPFVGIVLAIIIFIGGHIANFLFQVLGAGVNALRLNYVEFFSQFYMGGKNSYQAFKAKRQFTKVKK

SEQ ID NO: 6379 - protein, 226 aa, Methanobrevibacter ruminantium
MSSGADKIVSNIMSEAQGKADANIGEAQAQVDAILADGEKRAEATKLKISEDAAKQAEMRYQQIISEAKMNARRAELGAKEEVIEEAFNKATEDLTNMANTNDTEYVDALIEMIKEAAVEIGGGDLIVLLKKEDIPKIEGKLEHIVGLIKSLIKREKPSDLNVIAKEVSRETDVETTLEIGEPIDTIGGAILRTRNGEIQVNNTIESRMLRFKKSLRSEVAKTLFD

SEQ ID NO: 6380 - protein, 105 aa, Methanobrevibacter ruminantium
MSDVAIIGDIDTVTGFKLGGVKRGIIVNNDEEAKDALDELLNDEISIIIITQKIADNIREHINRRLGSDVLPMVIEIPDKSGSSEGGADQMAALIKRVIGVEMVK

SEQ ID NO: 6381 - protein, 584 aa, Methanobrevibacter ruminantium
MINEGNIIKIAGPVIVADGMRGTQMYEVVRVGEAKLIGEIIELEGDTATIQVYEETAGVKPGEKVESTGGPLSVELGPGVMGSIFDGIQRPLEVIKGISGDYIARGIDVDSIDKEKKWTFEPIAKVGDKVVGGDILGQVQETSAVVQKIMVPPMIEGTIKSIASQAEYTVLETIAEIETEDGIEEIQMLQKWPVRKGRPYKEKLDPDIPLITGQRAQDTFFCLAKGGAAAIPGPFGSGKTVTQQQLAKWADADIVVYIGCGERGNEMTEVLTEFPFLTDPKTGNPIMDRTVLIANTSNMPVAAREACVYTGITIAEYFRDQGYDVALMADSTSRWAEAMREISGRLEEMPGEEGYPAYLASRLAQFYERAGRVITLGQDPKESSVTVVGAVSPPGGDLSEPVTQNTLRICKVFWALDASLADKRHFPSINWLQSYSLYVESITNWWQENASEEWRANRDQAMVLLQKESELEEIVQLVGPDALPDSEQVVLETTRMLREDFLQQNAYDDVDTYCSPIKQAGMLETILKFHEAASAAVTRGADVKEIAALTVKEDIARMKYIPEDEFEARVKEIQEKVVTQCAEV

SEQ ID NO: 6382 - protein, 461 aa, Methanobrevibacter ruminantium
MNADIKTREYTTVSEVSGPLMVVEGVEGVAYNEIVEIEAPTGEHRRGQVLEVKDDVAVVQVFEGTTDLNTLNTKVRFTGETAKIGVSKDMMGRIFDGTGKPIDGGPEIIPEQELDINGNPMNPASREFPAEFIQTGISTIDGMNTLVRGQKLPIFSGSGLPHNDLAAQIARQAKVVGSDDDFAVIFAAMGITHEEANFFMRDFERTGALEKVTVFMNLADDPAIERILTPKMALTTAEYMAFELGMHVLVILTDLSNYCEALREISAARDEVPGRRGYPGYMYTDLAGIYERAGRIAGKEGSITQMPILVMPQDDITHPIPDLTGYITEGQIVLSRDIHRKGIYPPVDVLPSLSRLMSGGIGGDKTRDDHSGVSDQLYSAYAEGRNLRDLVAVVGEDALTERDQSFLAFAQAFEDEFITQAKDEDRSIVETLDLGWKLLTILPKTELKRVKDEFIEKYYPE

SEQ ID NO: 6383 - protein, 230 aa, Methanobrevibacter ruminantium
MAEEILEGINPTRMELLALKDREKLAVKGHSLLKQKRDALIKEFFDILDRVKGARENAETNLSEAYEALTEAQIIMGDLAVQKAALSVKESVKVDISSRSIMGVSVPIADMEMESRTLVERGYGFSDTSIQLDEAAKKFETALKYIIELGEIEKTIYLLADEIESTKRRVNSLEHIMIPRFQATIKSINMKLEEMERENFVRMKMIRSTIEKNEAEALAKAQLKAAKAEE

SEQ ID NO: 6384 - protein, 952 aa, Methanobrevibacter ruminantium
MISLSFVSASYALDSNHLGENDRSCLNSCSSLKYSLGDNKNNDLDNSADLNSLNPNSNNCLNSNKNNCNCYCKNQTDLNDDLNDSDNCPDSFAKKTNINHDKQLNDGEIDFSERNNQIFLISPENFSVFFDENNRLKEDYGGCTLVFEGDFAELGIIDISYPYTRITAKENSFKNTAFKLSASDIELSNLNISLDKEFKDNEYAGILVLSDYISIYNITLNYTVPANTNGFCIYSKGEGFRRITDLSLINNTITFTGNNLNEAWDYGIFLDKTDNALVYGNSLGSYLPLCEDNWYNNEYGAVSKMSSAGFVAQSCNDLKLSSNEINTYVTDSTQSSFAMDSCILYDCSDLTVERNTLYLEDIDSQDGKNNTLHGFDLYLCDDAIIAFNNIDLFTMGGNDGRKITSPLQVNGPSDNIRIAYNNITSSNFGSNCGIYSHNFYGDTHLEIISNFIDVAGFANSGEWSLLSGIEVQDSDDVIWNNTIIVTNLGDFKYNNKVYGISYSQNRNNYNSTFNVQYNNITTNGYYAVYLGKDDYPVVNSTVKNNVLNTYITGGNPAVSIANDNKNNPIVNNTDNEFKNIFKNSSFPKWLKNFLRQDTKVDKDFSWITDAINPQSNGTGFSNDTGNGTGIIDNDGSDTVGNNSEGSDSIVNGSTSANGTGNGTSGNATEPQNPIDDNQGDNSGGSSSSDNSTGSQTDNEDSNQNNTDPTDSKPTNNTDVPVNPTNTSDKPVNSTEPVPANDTEPVPANDTEPVPANDTGPVPDNKTDNPVNNTEPVQEDANKTDSDNTEPINTTKDNSTEIINKTESDDDTNQTVLKDDDLDPKESHENSQDDNKNPSDDEEKSTPGDSGNELTDPESNSESPQNQEENSENSNDDSSEPSSSTVGDSHSDSASSPGLSDASSSKNAYELDKPVEDLVTKSVDYISLAGICIVTLLLILFGYKRQKDIEGED

SEQ ID NO: 6385 - protein, 212 aa, Methanobrevibacter ruminantium
MVDVGGGILTYILDTLSQSLQIPVIIFLLIFAVGAIILLGGLIREYSHRKTISDAEMRNIIDAINKANDKSEILSIVDSSDIPNSQKTVLREITDSDWDNESRVGLAKKLISSREKRLEKRLSYTDIITRIGPTLGLMGTLIPMGPGLAALGTGDVVTLSNAIIVAFDTTVVGIGSGALAYVISKIRRRWYSEYINNIDVLTDVVLNKLNKL

SEQ ID NO: 6386 - protein, 440 aa, Methanobrevibacter ruminantium
MGKLSFSVAQRFGKKGTALPGKVALKFNPNLLEELSKKCDKIVFITGTNGKTTSNNLSTHVLKGGFNDVLSNLNGSNMIQGVLTPFITDYKDSYDVGIFEVDEGSVPVVSQFMKPDYFIITNFFRDQLDRYGEVETTIKMVHDSITPETVLIINSDEPSLLRFDDLPNKKVYYGINKTKFAQDDIDVAESIFCPKCGNRLSYEYIYYGNVGKYHCDKCGIENHPADYFIESADLINGSYNFTVLNDNKREEYTLNLMGLYNLYNSLGVISLAKEIGLDYNLIKERINNFEYRLGRMETFHFKNKDLVLVLSKNPVGLSEVFNTITYDESQKSVMFILNDYAPDGKDVSWIWDANFDPVNHIPNMDAFYCVGTRAEDLALRLKYAGVDESLLKIYPAKDQFDINEAVDTISKESTKAYVIGTFTAMPEARKILVKKEQEGF

SEQ ID NO: 6387 - protein, 258 aa, Methanobrevibacter ruminantium
MDNLELTVMNMYSDILNTYGDIGNFRCINQRIRWRDISLNIQECTIDKDDDFEWEDIDIILIGGGSDNNQSIVSNHLLEQRKDLVEFIENGGVLLAICGSYQMFGNKYLDVDGKDIPCLEVFDIETTSRPDRLIGDIVISNAIPDSNNVLNKDFDFKLKDMVGFENHGGRTYHNHDPLGHVKVGFGNNGEDKGEGMVYKNFLASYLHGPFLPKNPHIADYMIFNALNRKYSITEIKDLNDTIEIRAHERMLKRLLNDK

SEQ ID NO: 6388 - protein, 428 aa, Methanobrevibacter ruminantium
MENLLIMGINTRPMVNSALKLDYRTYSVSYFKTYDFVSPYNERHVLDQESVDSCGFFERNYSPQKLLDLSREYLFDLSKEHNSKKQDNENNEDIDEIDKIVLITGIHADDFKGEFSRFKTKIRGNINTKDLDDKFRFYQKTKNKFDVPLTFKLSDVDELRDILKQYNNNQFILKPLKGNGGLGIFLIDYDSLNELNNSNNPLENISFDDYILQEYIEGTSISSSVLGTNDDCVNLFNSRLVTENDLGNDNFAYSGNIVPLDVNSFNCFNESFKGLGIDSKQLNKEMKEISEDLIRQFRLIGSNGVDFILDRENNLKVIEINPRLQGTYELCEEIMDLNLLDAHIKACEGELVEVPKLNGRYGIKKIIYSSKQVKIGNLSLSNVYDVPYEGVKIEANQPIVTLIDSNKDLKTAIGNINTAEELVYKNIY

SEQ ID NO: 6389 - protein, 326 aa, Methanobrevibacter ruminantium
MNIFSTEETYYGTRKDSPVLLPSYNEYGDKLHIKDVFDFEEMLENYIIEMEIRNYSENTVKTYSSIIRSMIDYMSSEEGVYDGRKFLACFKKYIRDLKKDQDVSQNYIYLNTVVCKKFLEFNDIYFLEDVQNPKRTKSLPKSLTEKEVKSLIDAVQITDEDSELKKKAKMRDKVILEFLYSTGLRISELVKLQKKDIDFDERTIRVRGKGEKDRIVLFDENTRDLIDNYIETQNQKSEYLFINKNGRKLTPRYVQMMIKEYAEKAGIKKKVTPHVLRHSFATHLLKNGVDIRVIQQLLGHSSLSTTQIYTNVDMDTIKSVYDHARE

SEQ ID NO: 6390 - protein, 445 aa, Methanobrevibacter ruminantium
MGKGVELTTTKYLIHAQINANGIVEKPDVVGAVFGQTEGLLSNDLDLRELQRTGRIGRIQVIIHSNGGRAKGEIVIPSSLDRIETAILAASLETINRVGPCEASIEVLRVEDVRAVKRQQVINRAKEIYMGMMETVSPESMKMIEEIRESMRVHEISEFGEERLPAGPNVHTSDAIIVVEGRNDVLNLLKYGIKNTVAVEGVNIPTSVAELTKKRTVTAFVDGDRGGELILKELLQVGEVDYITRAPRGKEVEDLEKEEVLVALRDKAPTEQVINNLDFNLDTQAKTPKNKVNRTDRRAKNFNKSDKFHGNKRNDRKDKFNDRKDKNGKNDRRGKDRNSRGRRDRGDRIPESRMKLLKNMLRDLEGTGNSEILDDSLNLLKETKVETLYEDLKEDIPDADTIIFDGVISQRLVDIAHSKGVKTLVAFKSSRVIKRPDKLKLITLN

SEQ ID NO: 6391 - protein, 251 aa, Methanobrevibacter ruminantium
MEGVILAKIKPNDLLKKPSKIEKMELDQIDISKYQFSIDDLEGKDSSNYILLKKILDSSSSCQVSDAYASVSGRSGVLDGLKPMNRNKVYGRVFTAKTNTNDWGTSLMAMDNASQGEVLFIYSYGDKASVWGELASTCAGEKGIAGTILYGYARDMDALIDLDYPVYALDYCPNAGKALGLGKVDIVLEIGEDIIKPGDFVFADENGVVLIPQELFGETMVATFNVKVKESFIIKELKKGRLLSEIIGLER

SEQ ID NO: 6392 - protein, 120 aa, Methanobrevibacter ruminantium
MKFLGNISHLANSGKLIAKSSQTPPAGAFVFTNDKQKIGKVYNIFGPVKNPYISINLYRSVNKRDLESRQGEKLFVSTKREMEKDKKKKRSNKSKKGKYSKGKNKSKPSKKKRSNKKSRR

SEQ ID NO: 6393 - protein, 264 aa, Methanobrevibacter ruminantium
MGPEWRAFDHEQRDKRTRVGAPITYTIHDKGLSTMIDWRNKDIYGRDIPARNRAQWYRLRKWQRKIRISGATERNLAFALSELDRDSSRLGLPRSVREAASVIYRSAVENKLIRGRSIEGVVAASLYAACRQCKVPRTLDEIAEVSRVSKKEVGRTYRFLTRELHIKLPPTSPVDYVPRFASELGLSGEVQSRSIEIIEKAMEKGLTSGRGPTGVAAAALYIASVLLGERKTQRDVADVAGVTEVTIRNRYKELTEQLETGVTL

SEQ ID NO: 6394 - protein, 108 aa, Methanobrevibacter ruminantium
MLLSSTSTLESKTILKYHGLVSGESLIGANIYKDLFSGVRDVVEGRTSTYAEELDNARNEAIATMEEKAKEYGANGIIGLKISYNNLGGTMGNTILVTVYGTAVTYED

SEQ ID NO: 6395 - protein, 62 aa, Methanobrevibacter ruminantium
MVEPHKHCPVCGSPIPMKERVCSPDCEKVLEMNQKNIRKSRIMLFAVIVVFILVWAYFMFFK

SEQ ID NO: 6396 - protein, 264 aa, Methanobrevibacter ruminantium
MTGLIDIGLNLMHRSFDKNREEIINNAISNGVSQFVITGTSVKSSKIALNYAKDEKWNGILFSTAGVHPHDAKTCNEKTLDALKEFAKNDCVVAIGECGLDYNRNYSPQDVQREWFENQVKLAQELDMPLFLHEREAHEDMVKILSKYPEMCEKACVHCFTGTKEEAEKYLELGCYIGVTGWICDERRGQSLQEAVTVIPPEKMMIETDAPFLIPRNFPKKPKSNKNKPEYLPHILNTIAEYKECDSAELGEAVSKTTREFFKI

SEQ ID NO: 6397 - protein, 225 aa, Methanobrevibacter ruminantium
MRIVVAIGGSILLKTYDAQRFQEYSDILKDLSNEHEIFIVVGGGKPAREYIGVARDLGAGEAKCDDLGIEVTRVNAKLLLLALGDYAYQKVPHNFNEAQEYSASGKIVVMGGTEPAHSTDAVSAILAEFVQADMLINLTSVDGMYTKDPNKFDDAELISEITATDMMDFIRNQDVKAGTYEFFDFTAIQMIKRSNLETVIANGFEPQNLIKAINGEKIGTRVISD

SEQ ID NO: 6398 - protein, 2575 aa, Methanobrevibacter ruminantium
MSLNKLKIGRVFICLFILVFISCSINCVFAVDDLAFNDTYYSDLDSVNGDYSGFLSEGDFNGGSSVVVDGEIDSSPIANNKKNSSFALTSKKDSSSPSISTSSKNNKNNKNTSSLKENKTAAPSSQRVFYDRDIVSDEDVIGPGHENLDWINLTHVDDSLFSDNSKEDGAKGSKIATTIVASNLVKYYLNASQLNVGLKDSNGNYLSGKTINFTVGSASYIRTTNSSGRCSLTINLMPGVYTFTIRFLGDSSYSPSSKNVNVTVLKMPTSITASNLVKYYHNSSSLIATLKDTHGNPLSNMTVTFKMGSNNYNRTTNTNGKATLALNMIPGNFSVKISFTHPRYITSSKNVTVTVLSMPTSISASNLNMTYGDGSYLNATLKDAHNNPLSNKTIHYKLNNTIYNRTTNNNGQTSLIININPGTYQFNIYFNENYYQNSNKTATVTVNGIPNSIIASNLVAYVNESPTIVATLKDANNNPLSNKNLTFNRTGTLTNILTNANGQATYNLNGCTGNFNIKITFNTTGYAFSSKTVNVNIKFWPSTITANGATTYFTDTVQLSACLKGENNTPLANKNVKITYANKNITRTTNSAGNVYYDFNENVGTYNVNFSFKENYYQNASKTVTVTVNKMPTSITASNLNITYQDGSSLIATLKDSHGNPIANKTVNFKMETNNYNRTTDANGRATLALNMIPATFNVNITFSHPSYQTSSKSVTVTVNPISNSIIASNLVAYVNESPTIVATLKDANNNPLSNKNLTFNRTGTLTNILTNANGQATYNLNGCTGNFNVKITFNTTGYAITSKTVSVNIKFWPSTITANGATTYFTDTVQLSACLKGENNTPLANKNIKITYGNKNITRTTNSAGNVYYDFNENVGTYNVNFSFNQNYYQNASKTVTVTVNKMPTSITASNLNMTYQDGSSLIATLKDAHGNPIANKTVNFKMETNSYNRTTDANGRATLTLNMIPATFNVNITFSHPSYQTSSKSVTVTVNEIATNLAVSNLNMIYMDGSHLAATLTDGNNNPLANKTIIYTLGNVNYNYTTNNSGQTSLMIHLNPGTYQFTVQFSESHYQSAIKTVTVTVNPISNSIIANNLLAYVNESPHILASLKDSNNNPIINKTLVFNRSGNITNIITNANGQASYNLNGCTGNFNVTITFNATGYAFSSKTVNVNIKFYPSIISANGATDYYGNTIHLSASLKGENNTPLANRTVHISYANKNITRTTDSAGNIYYDFREIPGIYNVCFNFNQNYYQNASKTVSVVVLNPPSPNVNVSSGFYNVSYLLINVSSNISGGILYSSLDNGTTWYTGEDNICFNLTEGNWSVCSYYSLNGFNSSIVYNNFIIDGSAPLVWASNGSGFYKRSLDVNLTSLDIVDKNPVIYYTLDGSLPNNLSAIYTGPIHITSNYGLTKLQFYGVDRFGHNSSIVCVNYFHGNYVANLNSGKYFDSVQDAIDDMDTINGDVIEVNKDLSGACDLNKSVYLRSSCLNNFTWSQPNIVIHSNNSVIEGFDFDGSSMHSVILAGVSNCVIMNNRFSVVEYGIWSSLSGYNNVIMNNNFSSYGLSISFIYLSPIYGGENTYLIKDNIFNHSRCGICLESSLNSIISGNVFIGSNYGLKINGNNNSVVYNNLSFNSYAVCCFGDDNTLMYNNIVNNVYGIYGDYSNLTVNFNRFYNNSAFGLYASGGPINACNNWWGHNNLSVSEDYGFDICLQTDNIDYSSYIILKNYKSYFELRNNFIDNVSCVVDLNWNNLKEYVGEFIDGVNVKFVDMKTGPYPHWIAIESGQALYKTSCVNQVNNVIISLDDEIQTLNYSSFSSSVRFYINTTGFISNNSGNLDNFVANENGSYFTFDVILDHDVDWVSYVWRNIGDFKSELDLIVDGDIVSTSVVESSFYRNNLNNISSNVFDAILLYNDWYYSRLNWAKAVVYVYLSLEYNTTDLNDVQYIYSNVNWGCLSPERKNQLLNDHNITFNDALWNLIQNSYNLSDEDVIFIKNHHKSFNDSVCVSAHYYGNDNEIINLNNINNNTLAYSGGMVIGSWKAPIMYVDGSYQHFIGNNSDNSTDIFTYYHNYGNGSIDWAYSTNYGNLTNGTYDGLMTFTFANDKVNGSVLNHYLSEKNRTDVNGSLVYSNGFMKAAYGSFLEGLLVIYMDDLVADLVSSRYNASWERVSPMVMSVRDDHGRLVMSGESDFYFGRKLLCDDENIIKSFYFACSSVFSSIEHYVHQTLFPDRIGYGVTVDLGRLLADGECLSIVDEGRFIYICPNESDEIYYLCFDKLTGILMDASILGNDAYCYSNQQTEWAFTLGEELIDNCDLIWDYLNGLDVDICALNVSTQDMLKVCYGFNILSDLFTCALLSEVNILIESIGLEESFNAIVPLVGVLVSSLENIGSYVLDEYLSNPKFLSGVVGGLLFEAGMIATCTGVGAPVGLALMGAGTICTAYSSGLIDYNDNDGIYFNTTLENQANFGFSMSCNLISGGIGGLASSSAFKATGSEVIQIASKNAVIDSKGFYTTTISTKYVAYEGSSNTVSRYVINRMVNSQNPSKKIFILKGCRNILDSLMQDCIWEERNNLLIK

SEQ ID NO: 6399 - protein, 188 aa, Methanobrevibacter ruminantium
MGVLASVAGGIFFEAGMIATCTGVGLPVGLALMGVGTICTAYGSGLFGMTDTGNFYSNLTDENLADFGFSMSLNLIGGGYSAAAAKSTLRTVGGKSVQISISKAAFASDQRGAYTTFHTISSKTYIQKVENGAFSNCGEYLIEQEFGTTVIENIRKSLRVLSIDYALNFCYDFLKENYIKSLDGGLYV

SEQ ID NO: 6400 - protein, 55 aa, Methanobrevibacter ruminantium
MNAAYGSFLEGLLVIYMDDLVADAAGERYNVNWTRVSPMVMSVHDNIKGHILPGK

SEQ ID NO: 6401 - protein, 414 aa, Methanobrevibacter ruminantium
MSEVSSKELYEFKKTLKELAEKKGKGTELVSMYVPPEKQLSDIIKQMRDELGQSANIKSKSTRKNVQSAIEVIMQRIRMITNENKDLPNGFVLFVGMIPKGGPGTEKMETVVIEPPEPVQTYWYICDSTFFLEPLEDMIASKEVYGIAVIDRNEATIATLKGKRIKITAHLTSGVPGKHKAGGQSQRRFDRVIEQLAHEFLKRIGQHMDDDFLPIKDELKGIVLGGPGYTKEDFYNGDYMHYELKDKVITTVDTSYTGEFGIRETIDKASGALEELGVIKEKKLVQRFFKELRDDNGLYSYGEKEVRTNLQIGAVDILLLSEDLKSKRLTLDCQACGFHAEVTQKEGQKVEDLTCPQCNDKMKITKEEDLIEDLSNIAEDLGTEVEIISTETDEGMQLYRAFGGIAAITRYKVN

SEQ ID NO: 6402 - protein, 217 aa, Methanobrevibacter ruminantium
MSDKEVYGIVLSQKLTKDNVNMGVVMGTEKFTLKRIELNEDVRLKPQDKILITKDSEELKKTDQKLSYDDLSNEEQIEAEKAIHSIVIANENKYVGFFNKQSKDGTQLHLLEGISRKNSMKIIEEKELNGDFESFEDIDNRISFIDDSEDLIAKRVLYELSELNKVKKGRPTYLFASVKRSSKKEVLELDEFEDDDSFFIEKLKREGLVEQEGKRIR

SEQ ID NO: 6403 - protein, 141 aa, Methanobrevibacter ruminantium
MTDLNTCSNEKLSFKYNDKWELEAIPLENNPDCIATLSYEDGSLLNVIAFPSELESLDIFKEVVEASLRDDGAEIVSSEIANVNKRPSIQIHSKVTTPEISFQMFSVIFLEEGFLYIFELRAVSEIVHEFMEIVKSFEILE

SEQ ID NO: 6404 - protein, 267 aa, Methanobrevibacter ruminantium
MIIKAGKINKARGNIVLTIGKEDVNKHNLEDGDFIILTSDEYEDLKASSEIEVSTMEVIPDDEAVIKLEYDLKEAKSKEKILFSKVEELEKLNLELTTELSKIEKENYINKTVLTDSESGSLLEEIKNVNDKNEELNSEIKKLNKDLKESDEERIELLQDMNVLKTKMSFDAGEISRLRERESKYREVLEIILKSNKNILDEAVNKTVTATIHEINKELSQTGLIRRIRGLTIVREPEISKESISSNAYKQLEGVIPDEYFLDSPDE

SEQ ID NO: 6405 - protein, 167 aa, Methanobrevibacter ruminantium
MGYFRGEIMEEITFNEEGIKFKYLSNWREQAKESVGPNCIKALVKVVEGKPSTITVYKNDAGDAKAVAQLEEPFNESFKSQGWNIVKSAILNLNGNPVFNIVSDAQEGDTILENNTSAIINNGKMYVFELMHFKDFPYAYNDYLSIMDSLEFVNEEEIEETEEESEE

SEQ ID NO: 6406 - protein, 140 aa, Methanobrevibacter ruminantium
MSNLFQNDQLSFKYPKNWKLVSDDEIEGCLAILDSDSKHSRVMIFKYPEEGLSLEYLKNAIEDIPREESLKVISSNLTILANKETHELIAEDTSHEPPLRTHSLTTIHNRDAYGFNFMGFGLDNPDEEGFLFMYRTLKFE

SEQ ID NO: 6407 - protein, 203 aa, Methanobrevibacter ruminantium
MTLKEEKDKVRKSIYDNLFNNGFSNRPNGDYGKIPDFKGSDIAAELLSKTEEWKSSITIFSSPDAAQTPVRYLALKDNKNLIMASPNLTHGYLFLEGQNIKEIEEASTKEGAFKHCSKKDISNINVDLVVEGSVGVDRMGHRIGKGKGFADMEIEDLKKRNIINNTTPIATTIHPLQLVNHIPTESHDQRINMIVTTREIIRV

SEQ ID NO: 6408 - protein, 181 aa, Methanobrevibacter ruminantium
MADLKGTKTEANLAAAFAGESQAHTKYQYFASKAKKEGYVQIHDIFMETSKNEKEHAKIWFKLLHDGEVPDTIANLNAAADGENEEWTAMYKEFAETATEEGFPEIAGLFTMVGNIEKEHEERYRALLANVEGEAVFKKEAEIEWKCINCGHIVKAPEAPFICPVCKHPQAYFEERATNFK

SEQ ID NO: 6409 - protein, 142 aa, Methanobrevibacter ruminantium
MSDMWGLTVRGICEYNDKILLLKLRSISAHDPCKWEIPGGKVKKCEYFDSALKREYKEETGMDISIDSLYHVIQKNYTACKTGEKIKSIQLIMKVSTNSDEVLISDEHDMYGWFTKEEINDMIKNNELTPPAKAAFCKTLLV

SEQ ID NO: 6410 - protein, 168 aa, Methanobrevibacter ruminantium
MSMLSNYRLKELLKKESEMTDEEYELFLNEFRKSELFIPIQVDLDSLDLKDVQLNEINHINQEINFRLKSYESKDKKRTIPLFTDEHEIERLKMNTTVGSLFMRDLCESIMPIRDSFDQIIINPKSEKSFKISVDEFLDLFDEDREFEDLMKEIENDEEFIEMMKKEL

SEQ ID NO: 6411 - protein, 134 aa, Methanobrevibacter ruminantium
MTLSDNKKLKKLLKSKSRVKIENNPNLFYKEFLKSTLFVPVIAINEDENLNDGDTLDLQIGFFDEENGDRNIYIFTDSNEMERADYKITSIAVNMKELSVILSQFDMDFDYIVINPYGPDSYKIDYDEFKSRTE

SEQ ID NO: 6412 - protein, 159 aa, Methanobrevibacter ruminantium
MDFKREKYIEVLIYIIAKTANKKNVGKTVLANMLYFIDFDYYELYGESLTGETYFKTINGLKPKHFDDTLIDLIQRDIIYLKREADYDNKLKKYYIARIPDNKLSKKEYFVITDALDRFSNLSASKFNYILSKDIPFKSAKMDGQINYECVFHRLEKTN

SEQ ID NO: 6413 - protein, 282 aa, Methanobrevibacter ruminantium
MNEIIDNYNVNEKIEIDNFELEDIISLGVNNLTIADEEEFFKLLKEAQLFILVQLNKEEVFDVDNQKVVEVIKPIPPLGFNFMTLTVNENERSIVAFTRKEIIKEIGLKADHIVMNMRDLAKILMGLGDTFSSIIINPQTEHSIMISINTFLSLFMEKPKNPFIGSLEQTLDKLKNDYVELDNHYMFFIRSDYEFMENESKDGVFVAKMPLRASTDPNFQANLPILHKLMMMEGQKVLYTGNPNEEQTDFDVLIAPGTEFEKYYDEDGDTSVWRCVKQPFYE

SEQ ID NO: 6414 - protein, 142 aa, Methanobrevibacter ruminantium
MQDEPNKKINRAKDDENLLFARGEVIRLMKDHLDKDKMITERVKVEMNRFLSNVLVAVCEELNKYPYTTIDYEMLKESTYPYTRIKQINQERERILVHLNAIKADCDALGMDIEKTLKLNESDGEDSDFVPHTSRVKEDDGE

SEQ ID NO: 6415 - protein, 481 aa, Methanobrevibacter ruminantium
MDNEFKINYLLNILKTTPKVVSDRIIKDQTRLNFRKDYYDLKESIDNFLEHDTDDRFYILPGLRGVGKTTIVFQLYDYLTNERNINSNHILYLDLDRLKDQGPFNLLEYLDIFIKDINEEAYLNNWPLFIFIDESQYSSNWDHVGKIIFDDYKNVFIIFTGSDALNLQSSMDSARRSLKKEIYPLNFAEYLYLKYGCEIPRGISDSIFNAILFNDFENLIKDERYIQLNVYNKFKRDINKIWDEYIQYGGFPLSFARKNHASIIQLGLDMKNRIVEKDLDIVLSVNSQTRLNTYSLINILALQKPGTLSYNKLAKNLEISKKTVGNLLNALECTQMIFHIEPHGAITKRNRRPWKYYFLSSQMKAAIYQNSGQATKTKGEYMGILTENLVGSLLFMMKNKRKQDFGIFYEEEKERADFLINTIDGRIIPIEAGYGKKGKRQVINSMEDHGSEYGIVVSNKTQSIKIEENVIFLPLKTFSML

SEQ ID NO: 6416 - protein, 264 aa, Methanobrevibacter ruminantium
MGLAKEARDLERENKYDDAFELAEEARKLEKNGKYDEAIELILNYLDQNPQYKTIDYYHFANPIEEILFNVYIEDIDSVKTLNLEECLELIYFTLARAYGKKGDKEKEEKYLKIANKINPVSAIILLRLCKYCQSINENEKIKELAPDIMKYSYNSKILIESYLTLAFSYLDDKQEKELYNHLMQFYLTVETGTDFWDSIKEDIKYLEEHEIQVGFNPEMFSILKYLIALHTKQGREDTAKYFKDILYLMEEFTKSLNELRYDS

SEQ ID NO: 6417 - protein, 337 aa, Methanobrevibacter ruminantium
MDCIKNGIMGQIVGDALGLPVQFQPREERDIDPVTDMIGDGAFELPAGSWSDDSSLILATMDGLIKSLNGDNVDSTSLNDIIDWEIIMRNFSDWLNLGEYTPYGFSFDIGGATRDGIYNYDDGWEPLECGGIGERDNGNGSLMRILPIAFFIYYLSKKYSFIEEDKMTAVHNLSSLTHRHKRSQMCCGIYVNIALEFIDNFENGKCLDLEELISSGINKSKEYYFNDDSFEEELHHFDRVFSLNIQNLPRDEIKSGGYCISSLEASIWCLLNNENYKDTLLTAVNLGYDTDTTACVVGGLAGIFYGYEDIPADWITQLAKLDYIENMIGKFSQSLID

SEQ ID NO: 6418 - protein, 135 aa, Methanobrevibacter ruminantium
MYDLTKIQKTFNERVFSRLDDEILERNGIDKDEELIREELFRQREIITVPFGHIEYFLAIEDEKVLLYVEKASRMGSHNICIIDDDSYECIDVYDGYPPELKERYLDHLKRIKKTRNRFEENLKKLSEEKSIKEK

SEQ ID NO: 6419 - protein, 321 aa, Methanobrevibacter ruminantium
MQFGNYAVEISSENENHLINYLKFNNFKYEKDLENCSEKEEYVIVINIIERIYYKIKNYLAGPILSEKDFLDKINYNKYSIHKKAYSNDGNLIYEGYTIYEQGYGEIAYGLGTSYFPNGNKCHEGVFERKGLLEGKEFYSNGQLKFEGTYGRCRGYGPHYPSFGNYYSKDGQLLFSGKFKVTFGGVGYPMIKEPKYKLLEKGRPRYILKKDEDITKLIEKNTNIENKKYPMTFEEFEEKVLELFFEYHSDEFIEILKKRLEDYKKIEPNFMKALYKHSCWVYDSPHIYGDTCKLQFEKERLRHYPVYRLRVIVGLEDGFRG

SEQ ID NO: 6420 - protein, 188 aa, Methanobrevibacter ruminantium
MISINIKEMRKEKIYEGRVKMGHGGRGTIRLHNSNIGDQLYVIFPSYGKKEDKDGNLEIDEILRKTVELGKDGKNNIDFNREYRGRKCIIIKRESLIKLEFAKWKIIYDGIVKKSFNGQGLIRVKDMFLGERAFVVFGESLNDSNENIMVSVNEIRNKGIHPDNDHTSRVLLSKDYVNCKCLVVLQEA

SEQ ID NO: 6421 - protein, 496 aa, Methanobrevibacter ruminantium
MSKIHLSKSKYCKCVQCEKILWLGRYKPEVAAVEDKETIFENGRKVGELAKGLFGEYEDIEFDITLTQMIEKTKKLLEEKPNVITEASFSYENNFCSVDILKNDEDGVELYEVKSSTSIKEIYLDDVAFQYYVLSSLGLNVKKAALVYVNNEYIRGEDLDISQYFIIEDITEIAMAKQDEVRANIEHINNFMEAHDRDNEPNMEIGMHCCNPYSCDFWAYCTKELPKPNVFDISGMYKSQKFESYAEGKVSFEDLRSANINPRYLEQIDFELNDRGPKVEKQAIKDFLNSLKYPLYFIDYESCNYPIPELEGTKPYQQIPFQYSLHIIKEEGAPLEHKEFLGDINDKNIIRTFAEHMINDLQEDGSVIVYNKSFESARNREIGEMYPDLKGQMNRINDNMVDLMVPFRQRNYYTKEMEGSYSIKYVLPALYPDDPELDYGNLPSVHNGGEASDAFLNLKGKSPEEQEQTREDLLKYCWLDTYAMVKIWEKFKEVAK

SEQ ID NO: 6422 - protein, 115 aa, Methanobrevibacter ruminantium
MKLRNLHLDYKDENGDLRYELRNGAHSMKDAEGFSPEEFYSSLDNVIRVLSPNNSFRPIEAYPSNNGPKALFGFLFYFLKGMGCKKGLQKEFDYLEQFIDYEIDLFMIVNFLREL

SEQ ID NO: 6423 - protein, 97 aa, Methanobrevibacter ruminantium
MISSEEKEKIKSDIVEKVNSVLEKYNESFRMDKVTVLNRAETVKFMGSYRVYERRNYCSVSREINSFLNKYGDVEIKSKKIRDSGMKFTTVSFNFEL

SEQ ID NO: 6424 - protein, 273 aa, Methanobrevibacter ruminantium
MAENEIKLFNDKQIRTKWDEEIGDYYFSVIDVIAVLTESSNPSRYWSELKKKICEEQGQPFENIERLKLPAKDGKMRLTDVANTKQLLRIIQSVPSPKAEPFKQWLAQVGSERLDEIVDPELGMERLKSTYRKKGYSEKWISQRMRSIEIRDDLTAEWDRVGVEEGLEYAILTNEISKASFGLTTRQHKNYKGLKKESLRDNMTNAELVINMLGELATTEISKTENPGGFEESKHVAKRGGNIAGNARKELEANTGRKVLSKANAKDKNLLEN

SEQ ID NO: 6425 - protein, 97 aa, Methanobrevibacter ruminantium
MISIEEKEKIKSEIVEKVNSVLEKYNESFRMDKVTVLNRAETVKFMGSYRVYERRNYGSVSREINSFLNKYGDVEIKSKKIRDSGMKFTTVSFNFEL

SEQ ID NO: 6426 - protein, 286 aa, Methanobrevibacter ruminantium
MNESQDIEETTKVDNSRLEELLQLFKDDPSPQNVQELGEEIKSSQLYLPVVYSQSMIEDILSGDVGEVREFKEPAGFDINFLTNNRGEKAIPLFTSDRIMEEAGLRSSVIVMHVEDLVDSLQGTENTYQLVTINPMTETGIDMPILTFLNMFKKREMSEEEKRFLESMNRMLEVLENHSIALEEKTAFFNRGPQDFMKEVAVDGVFVPNIPFSVSTIKEFEEDVSPYLNIILMDEGKRIVYFGEPTEENPFNVLLAPGCEIEMVEEVDEFTTVWKCGNQPFYDGMK

SEQ ID NO: 6427 - protein, 47 aa, Methanobrevibacter ruminantium
MAKATNKYRGDYITRLNETKYVEFNIGNAPKAMIFSRCDISKGGRET

SEQ ID NO: 6428 - protein, 106 aa, Methanobrevibacter ruminantium
MSFPTQIRNEQEFRLALLHFLGDINVGLVYTKKFFKEFMGLDNSVRQILVNQIKNALKNPGCGKFMSHNYKGEKAVRVDKRYRLHFKYDKKENLFELVSFYKKDYQ

SEQ ID NO: 6429 - protein, 443 aa, Methanobrevibacter ruminantium
MSNECLRCGYANEDNEKFCINCGAKLMEADSSIPDDIISCYFCGYKNHEDNKFCIKCGTRIHHELPYENELTEIYTRYGDVVDFNKVSYNIYYKYNLPQDCFLLNSELNNYEKYHEEYDMECPFCHQNSFSVIDSDISIGSVKITEFHEDEYHCSSCGLEIKLCKKDDKKIPGRRYLIANMDNKEHWIWKKYGKTPLYKYELDEIFNGGLSDDDKARLLSIHADYNRKAIKIVNRFSIYVSVRFAAEILSEEENSLKPIDTTFFLDDDEEAYFMFTDIDYSKPMVRYSTFGQSQGTYDAVTYGQSFDNAFSYLNGRSFYADTMGYFSTSTYSSTVSYEKVKVVDRGILLLTNKRLIFSGSIHSLDIDIDKILNLVHDRQSLMIHVKGRSNIVKFSNLDSNTFYLNLDGRQLSLNFTGYLLRTLIVKFMSPKKKRNLLKSKGSL

SEQ ID NO: 6430 - protein, 105 aa, Methanobrevibacter ruminantium
MNISEKIKEMQGDLGKYHALEKKEGECGLENLIMLILNDGGQFGPGKIIGESSEFLDFMFYKRQGPIFSLSIKKEHLSGFSIFHKAIDDEKQAAANIGIPKALYQ

SEQ ID NO: 6431 - protein, 107 aa, Methanobrevibacter ruminantium
MNFSEKIEEIQGKVKSYNSEIKGMKNIPSEKMIRVMMAEGEILEPCMIIGESDEYIDLMVVDLDKGPVFTVSIKKERIVGFGTFHKPLDELAYPEEELNAVPAALYL

SEQ ID NO: 6432 - protein, 102 aa, Methanobrevibacter ruminantium
MQIIEKVEKELEKLGLTVDTVANDHIIEACVTKVSLEDNLSKVGIDFDQIEKKLYPYSTFVIQMIQHLDEGGSTEDMIRAFLIEALNYSLELGDAFGISLEE

SEQ ID NO: 6433 - protein, 261 aa, Methanobrevibacter ruminantium
MKYCKICRKEFPRDLMFCPECNSFLEPVSHSKTLDEGIVEHGINRIIFFDTETSGLNPNYCKIIELGMLVIEDGKIIEEYDKLINIGERIDSTITRITGITNDMLIDEGVSEGDVAQDLKEKLISGTLMIAYNCQFDLSFAYGLLKRHYPHEAEAIIEDVKWLDPMTVFKDRKAYPHKFSDAVEHYDIRNVNFHRAIGDAKGLYEVCLSLKDERDDLGEYINVFGYNPRYGINGLKFPFIEYKKHYYNDSMVSPNNILPKI

SEQ ID NO: 6434 - protein, 315 aa, Methanobrevibacter ruminantium
MKLENFKYETNDNNLINYYEIDNDNPILLIIHAQSTNSSSYSDVVKDLSKRFHLILVDCYGHGKSSHNRDKYNIVSQGDDLIDFIKSKTDEKISVLGHSSGGLIACYISSRSDLCDNLILEDPPLFSSSGEKRFDYYNYHDLSTVCHNFINQDEEKDFVYYYFMNQYMWNFFPESSREKIRNKSGASALKYREKHPDKPLKVRFWPKNVLEAFNGMEEYDPYFGENFYNDSFNCDIDYAELLSNIKCKTLFLKANTKIGEDGIIQGALTDDDLNQVMNLIENIEVEYFDCGHGIHNEKKKEFVKAVIGTTKIFTI

SEQ ID NO: 6435 - protein, 1093 aa, Methanobrevibacter ruminantium
MMRKTIFGVIFIVFILFSISTVSANDAQVDMLNDASDVELNQDLNAQPISSNCYDNNQNLKAQPISDCSDELQKSDDDLKLSEGGSTSFKQLCEDLNKSDGEFNLTHSYKHDESDEENTAVFYMENLVINGNNNIIDSSKSNFNFKFSNEANITINDLTFTNFNKSLFVISDSQLTFNNVNFTNCSSNLSLIAIMFPSNLTINNCNFYSNSFANYLDGPFNKLEIYNSNFDGTNCLDSAIKENRGQLVIENSSFENFTGVHGSIINYKGDYFSIKNSKFINSNSNFTGGAIIVKYFPIAYEEGDSFVYRHSNDMLIENCTFYNLSSSSNGGAIHLDLDSGSEGIVETLIVKSSNFTDCHSKFGGAISILGGYLNISYSNFQNNSASFEGGAIYSSWTNAKIEGSNFTANEGSQNAGALYFDKGKLTINDCKFIDNKALKERERTANAIYAHDVAAYFSNSTFDNGGVSVYADFASDSKIENVDKNDDIFLMDNHDYIVSVESKGIKLNLTGNEINVDSLPSHFDARDWGWTTSAKIQGDNTDCWAFASISSLETSFAKASGVLYNLSQNYLQKLQLKYFYSGDKRNSLTGFSYSGPGYALSWYGVLPVDNGYDDRGMIADTDLEDERIHVQDVLFIDTGRDDAVELIKWAILKYGAVTVQRGINGPYGELPTEGDDIAIMSHGTHFISLIGWDDNYFELEEGDDDPLHKFAWITKDSLSGFSTADYTKFDAIDNYAIVPQRAAVAYIFENDIDYHVNYQTDLTGLVGFDANYNYYSNEFVSKYDEFIGAVGTYFNESGIDYSFDVYLNSEKMLSQSGVSEFAGFRTIKLDEYIHIKAGDVFKVVFKSNSIPFQAYSRQHYIEGMSLASADGESWSDLAPLNKTVCLKAYTVKEDKEVSPSRASTKIDCSNMTTTAVASADGRIGEYFVVTLKDQNGTVIANKPIKIGFNGRVYDRVTDENGSAKLQINLAYKGTYTFAIGFLGDENYLGAFEVAKITVNKQSPKLASPNKSYKLTAKTKTLNASLKSGNGNPVSGKKITFTVNGKTYTATSNSKGVATVKVSLNKKGTYSFTVKYAGDDTFAAVTTKAKLTIK

SEQ ID NO: 6436 - protein, 381 aa, Methanobrevibacter ruminantium
MTKLGMGMMRLPLLDENDFKSIDYDEVNKMVDLYMESGFNHFDTAFVYHEGIGEESLRKSVVERYPRDSFTVSTKLPLFVITEESQLEGLFKQQLDNCGLDYFDYYLLHNVSGFTENAWKNVDLYSFIQKKKEDGFIKHIGLSTHGNSEFLDGILSKHPELEFVLLQISYLDWEDEAIESRKCLEVAKKHNVKVMIMEPFKGGFLADVPQEAEKIMKDYNPDKSVISWAMRFVANLDGVCLVFTGASNSKQLEENIEEFKNADPLNDDEIEILKEVSQIINKNITVDCTKCRYCVDNCSSNIDIAKLFDIYNKHKLLDTDEWTPHGNAYLNYSKLPDVGIASDCTECEICIEECPQKINIPEVLKDVAKTFETGIYGFGNE

SEQ ID NO: 6437 - protein, 66 aa, Methanobrevibacter ruminantium
MSEIPVAPVVRILKEAGAERITDDAKKAFADAVEASAEELAKKVIKAAAHAGRKTVTVDDIKFVCE

SEQ ID NO: 6438 - protein, 468 aa, Methanobrevibacter ruminantium
MTTLKLTRLNEPNIEKLYEMKSALRNILEEGDFKNLNTILDFQDKDGSFKLFSTYRIPSDARVDFCHEPTYICSSILMKAYLTGDSELRQKIETPLIHGLERCCCRNLTGHGYDSLQGQIDALNIFMKGGLREFIDLHPDLNSKFTEMILNIMVEFDAREEQGIFKGTWGEDYKEDILKINEYFSTRKVFVYGTLMNGESNHHFLENSICLGKAAIEGYDMYNVGGWYPAIIPGNSRIIGELYEVPENDMASIDMLEGEGSLYIRKCEITTGNELAYIYEYAQDTEGLEKIDSWKDYVWYVSYGSNMLEERFLYYIEGGCFEGSASYRYPCEDPTRPLEKRAIDIPYDMYFGNYSGSWHGGGVSFLDTEKEGHALGTAYLITREQFEHVAAEENGGRPPNGNGYWYENIINLGEMDGFEMLTVTNKDLREYNRPSDEYLETLERGIRENWPDMSEEDIDDYLNSCIRE

SEQ ID NO: 6439 - protein, 352 aa, Methanobrevibacter ruminantium
MKHRLNLDNKDPNYILLKEIFKIMDSRESKRILVSYGFKNLNRTIFAFKIIFISMFFEIDIPFILNELKSNRRLCKFLNISEVLTADQVYKIFSEINSEKLIKSLNRILNSRNMVKRRGKKTFIVDATPVDLDINFHRNKKTKEHLEKINLKWSYSSSKGYYIGFKATVVMDYDSMNPVCILIHSGAPNDAGLFEEILENLQKRRIIRKGDTLIFDKGYYRYKNYQIGISKYKIIPFIFPKEKFSRTRLDDILTYPLAVFNKTKRIMKEKRLYNSLKMELMKKIDSWEKFKPIRGKIEDFFKLLKQGLNMREIHKYTLKSVEKTVYLNVFLGALIISQGFYSKTTIQQLSEN

SEQ ID NO: 6440 - protein, 808 aa, Methanobrevibacter ruminantium
MNNETNAFTGNNPELYNRLKSSINNAESIDIIVSFLMESGVKLIINDLKEAISKGVEIRILTGNYLNITQPQALYLLRKELGYNLDLRFYNVANKSFHPKAYIFHNESDSEIYIGSSNLSKGALTDSIEWNYHFKRSKNLEDFDSFYQNFEDLFYNQSTIVDDEALRDYSKKWTKPRFPVKEAESIEEYTQTPSETLFEPRGPQIEALYALERSREEGFDKALVVAATGIGKTYLAAFDSIKYKKVLFIAHREEIIKQAAKSFKNVFPTKTIGFFYNQHKQTDKDMIFSLVQTLGKSSYLNDSYFKRDEFDYIVVDEFHHAVANNYKKILDYFKPKFLLGLTATPERLDNRDVFALCDYNNVYEIRLKEAINKGWLVPFRYYGIYDDTIDYSTVNMRNGRYDEKDLEEKLMINRRANLVYHHFLKYTSKSAIGFCASRNHAEYMASYFNEHGIAAASVYSGEQGEHSQNRQKAIDDLRDGKLRIIFTVDIFNEGLDLPSIDEVLFLRPTQSPTIFLQQLGRGLRKDKGKKYLTVLDFIGNYKKANMAPFLLSGKDYDSRTLLREAVLDFEYPEDCFIDFDFQLVDLFKYQAKSELKAKDRVVIEFNSVKTELDHRPSRVELFLHMDDAIIGAMKRTPKINLFKDYMSFLNDNKELMDEEEEFLNSPAHEFLKAIENTNMTKSYKMPILRAFYNNGSIKMAISDDDVYLAMKEFYDYGSNGVDMLKDKSSRDYKSWSKKDYVNLAKRNPIKFLKKTHGDFFIDKEGFALALADNLEQFINLDSFKRHFEDIIEYRTLSYYKDRFEKKQV

SEQ ID NO: 6441 - protein, 192 aa, Methanobrevibacter ruminantium
MSENYYDSNADDFFNGTVNVDMSPQYEDFLNEIPKNGHILDAGCGSGRDTLAFKSLGYKVTSFDGSIEMCRLASNHTGQEVLHLQFQEIDFKETFDGIWASASLLHIPTSEIDDVLKRLKKSLKKGGAFYASFKYGSFEGERNGRYFYDLTDITAKELFTKNGFNIKKIWFTQDARKEREDEKWVNILAIKD

SEQ ID NO: 6442 - protein, 209 aa, Methanobrevibacter ruminantium
MICPNCNKFYNDNFAFCPHCGAEKPEPLTCPKCGFKSNEFKFCPKCGAELKKSAIKKPTKTCSNCGHENAINRKYCERCGTDFPREENRRFETKIEQPKRILLDYVNKFQIEENIKKEIINDINNEKITTKTEITIRVRQAQKEKKEQDKIRKEKEEKERMLENEYYRNSETNTQYHTYDDKPDVFYGGNEYREIEENTLGEYNYYREY

SEQ ID NO: 6443 - protein, 179 aa, Methanobrevibacter ruminantium
MTEYTICPACKRKNSIKEKYCLDCGQKLIEEKENEIIRDDKLEIPKDKIILLDLNYTLISNSWKIRHEELPQKILKRQYEDELVEKIKDNYVILITASPYKTSFDSLKHIEENTDLKISESYWNFGKRPPELKEYWLKKAVLPSHGDDSSKYLALESNKDTREMYARFGIEARPKSDFI

SEQ ID NO: 6444 - protein, 278 aa, Methanobrevibacter ruminantium
MEYYLQQLTNNHLEYLFELKFVTSEFELPGLADDIDCKKLEECGKKSESLRIDGLGFDNKTNSFVIIEYKNQYDKCVIDQAKCYYKNLLDKKEAYIEKYYEKFGKDKEVEFDFDKTRAIIIGPEFSEQQKNRKDPDFDFELYTVSLCKYNNKIYRALYKKVDSNFKRELYFSSEDLKITRCSLLENKSDKVKKLYKDFENILFERFDDDFILDIRYIVDGVSITAEKSSICLLRVNKKSIKIHFYTDELEDETLNHENICDVIDNINTIYNQKRRNKK

SEQ ID NO: 6445 - protein, 186 aa, Methanobrevibacter ruminantium
MENPVDITAIDGIKRISKSYDIDTSEYYDDGLYISWISLIKSKNDTVCPDCGSKLMPLTLCPSEEMMELDEMGFDLENHNYYCRNCDYELYIDVLNIDCENHPIECAYLYYKLDEITKYIRHNEYSDELKSKMDYFDDEEFNAFISKLKEVDYIYEDEEGYVKLVDDVENHWFRHYIKYKRLCREL

SEQ ID NO: 6446 - protein, 39 aa, Methanobrevibacter ruminantium
MSIDKLLLEIYELIESEDYEKSLELCNQILEFDENNKDA

SEQ ID NO: 6447 - protein, 499 aa, Methanobrevibacter ruminantium
MRMTPSSHSSLKKAFFKKNTYGGITMNKIKLTRQDEPDFDELYRMIGELKDFLKEDMGSRNWMKNLETILDFQDTDGSFKLFTSYEIPSDARVDFCHMPTYICTAILMKSYLIGDSKLSKKIDRPLRRGLKACCMRNLMGHGYEALEGQIEALNIFMKAGLREFIDLYPDMSRKFSKMISNICGSNFEMLESLRNALLGPWGEDYKEDILKINKYFNTRRVFVYGTLMNGESNHHFLENSNCLGASTVEGYQMYNVGWYPAIVPGDGMIIGELYEVPQEDMARIDMLEGEGSLYIRKCEMTSSKSLAYIYEFLEDTEGLDRISSWKDYIWYVSYGSNMLYDRFICYIEGGSYEGSSSYRMPCEDTSAPVEVRAVEIPHDMYFGNYSGSWHGGGVSFLDTEKDGHALGTAYLITREQFEHVAAEENGGRYPDGTGNWYEDIISLGDMDGFEMLTVTNKKPREQNEPSEEYLETLKRGIRENWPDMSEEDIGRYLNSCIRE

SEQ ID NO: 6448 - protein, 280 aa, Methanobrevibacter ruminantium
MVNYGDDSLENPDDITLPFFAYGIFKPGEIAYSNIKKYIGKKNEKTINYAMKQRDGVPILLPEENNGKTHGYIFKFNDNERAYDTINHNLSNKLYEWGTIEQGKINVLFGKDPDIGSDDIGPDFDRENYKGKDDPFFKEALAIKQYVESNDFTSKDDFYDLQRYYILLWSAIERCCKLKYNKESDGKNREEFSKEKEFIDALDKCDETNYREIYKTDDLTPRKFDTDEPKWCINYYYTLRCNIVHRGKSNVNRDMGLLLQATKDLLNIFEHILDETFKEE

SEQ ID NO: 6449 - protein, 137 aa, Methanobrevibacter ruminantium
MKKIILGTCILFLLISVAYAGTVDIFTAPSPLQPLGNSGFGDGQGHNIQIFEFTENLYKTWFENDTDYVVEKYEGNNGLYLYADDENDCGILEIVEKDGKKYIVNSWTPKGPSEAQTVVENLHDFNELNHLTPITTL

SEQ ID NO: 6450 - protein, 317 aa, Methanobrevibacter ruminantium
MNIDYDGHNSTNPNNNSIVENNNNNQLSLQVPQKYEDYDIIEELQCFNCNQHTFIQLNKKSLLSNKVVYYCTNCGMSFEKQGNGFKLVDISDKSNRMWELYNLKTLTWPEWERIANGGLSDKDQAEKDKQLAIEKQKELELQRKKDLEIVVQELAKGEVNLKPVSSPVILKKNETAYLSLPNITLSEPRAVRVSKSGGYGTSYRFAKGFSVHSGVGESRSVSHDEIMAIDTGTFVITNKRVIFVGNKKSVNIDLKKILSMTVYKDGISIQRENKQKIEYFTKTNRHSMDFTIDGRTHSLPLEGYFIKAIILGQIANL

SEQ ID NO: 6451 - protein, 347 aa, Methanobrevibacter ruminantium
MFCHNCGSEISDDANFCVNCGAKLIRLDEEKAQPSKSSSRGLSNKKTDEQKETSSGRGLFNKKTDEQKETSSGRGLFNKKTKEQKEAIKEIKSYTKGNYKRFRQIIPRYGILAMEVSHTKVFNGIIKTIRKEIENENLTADQIEGRVFQLLTEEYGEPMSQEEADELFNQQNLQTKLENERKLEQKFGVPFQNRVWFKCTVEEMRHSTFTNTNDRDIVDGYVFVEDTFLEIVKESVFLKSKMGTRKIFYDNIASIDHDAKGRLNLSSSLEIYLKSSDRVQLKHVNKGMVDLVTGKYNEYMENKINDNAENVTNGTNSNVDELMKYADLYERGLLTQEEFEQKKKELL

SEQ ID NO: 6452 - protein, 243 aa, Methanobrevibacter ruminantium
MRLKIILKSKKNRLKIPFNYNHIVSAIIYNKIADIKYAEELHSSNSYKFFTFSQLNIHKFKRIHSGFLSQNGKIDFLISSPDDYLIKSLVEGFLNDLTINFIGEDLLIEKVELLPVPDFEEEINVKTLSPIISRTKKEVDGELKIWDLAPGDHFFKNLENTLIYKYLEFNGLESNDKNIKIFSEMRNVKRKRIIIEKGDKQTYHRAYMMDLILKGDKELLRFAYDAGLGEKSGLGFGMVKVIN

SEQ ID NO: 6453 - protein, 719 aa, Methanobrevibacter ruminantium
MISDLVDFGKWLVENNEDGIGYMVKEDDYLLKITYNNEIDDFVIDGIFENDNEIVLGFYEKSIFNDILPTPRGSSDQNITIANNTNLMGFSPFLLNLDSDFLGRKIKPENYDNESDYYKVGSERFLKKKAGGKFKLEKTLDKFTRSLDDNKNNKQFNNDIITKLFDNPNELFLKNIPSQYEDIFIQEFFNNLSKEEYIKIINKFYKFLDMNKNDILDRVIKFKLEENVSSRFFIVGVFGDYRDLINDLCFLYCKLIKTRNKHIENYDGGICSIPNCNNHSITYPSIQFYAADKKFYFNYSNNIENSSLRLCDLCNRYMLFAFEKLKANFKGNILVIPKTYDGDYSEFLEIIQEDNDFEVINELLEENSKKFTYDFLIYTPSNALLKIEKYIDNYQAFLTKFDDINLYNYGNLNYLYNEVLVNDESSLDEDRIIIKISNLFDFQIIFKELFYEVDDGRLKYPKMNYFYQIYNKELTGENGIFNGFSSKTVNIFSKYKDNIFSFIYEANFDALNKNMINTIVLNSLTIFQKNSIKKSIRFEIVKRLNYWFMFKKEFLGDTMLLNENVLKLRQIFGHPNITTGENNNEKIEVVFDDVEKKQVLDLIKEDNAIKYYLIGQLIAYIDDFKYSSGKKREVFTNFITNAHRNNIKKLFATEILQKNVFYINQMNKKGKFLFTMLESDYGSLFNEEDLSYEDYILLLFTGYYTTKFLKKNYVYNGDE

SEQ ID NO: 6454 - protein, 319 aa, Methanobrevibacter ruminantium
MTEGTPVRNYYQGIYLTETIMGNPNGDFIDNSPRNVDGAVFTTDKCIKYNVRKYIHDTLENFGEKENIVFFFPRLIDSTNEEDMKFKTRDQVFEHFKNFEEILKVSPDVRMFGGTFSVDNNAKQIYGPIQLSYGLDINGAQIIRHQIGAPFATSEGSQKTVGSESVVDDAIIAYDITINPNNYKDLLLEDDLELFKKALWEGTNLRKTTSKKTDSKLLILIKFKNDSENDKVDAINMGELKQLISIKGGKSKKMDENTICLDCENLVKKIKKYEKYIECIDIYCDSDDVELNSLEIDGENLKDTNIKVNIYEPLSLLSD

SEQ ID NO: 6455 - protein, 287 aa, Methanobrevibacter ruminantium
MKIIEVDIWSSFGCFSKHFSNTGGVLTHLIPPKTSIIGIIGAILGYDVNDYEDNDDGTKTYKIESLNNIKVSIYPLFEFKTKRVIFNLVSGTNLDLDIKNINQDVLISPRYKLFISFPSELDEVEELFLNRVKNNKTIYNLYMGRNEFPLNLEFVREINAEKHIFSNDNSDELKSIKVYGSLNRSSIKSLNLSYEDNDSKVDSDALSLISSLLISNSADGVRHLKSFHEFTIKDYPIKRENFTDFSYSPVSFYSSKKFGECFFSNLQLKDGEIELVNIGDDKWLSLI

SEQ ID NO: 6456 - protein, 941 aa, Methanobrevibacter ruminantium
MVISHLNFNENESVIEINSDYFKVYAHKNELFNEHISKTLNIFKTIKSENILINFYDWFKDQGYIHLTFEEFNFLIEECVRFHDVGKLSFNFQLKRLNKNNPAKKKEQINVLKKFGLDSILNQFEGNHSLSGALSFLSKYYDVLPKNELFFLILAYVIIGHHTNLKDIVSQDDFFYKEFEENQALSTTLKFFALFFGLNQSTINQKFFQEINDIGFDFLENTINHYDSSFSFFYSYIYSLLISADSLATSEYKNSTDQIDYSKFNHRISDKLFAHMYKSFYNVKHNRNLLNETFNLNDICPEDINVLRKAMLLESSETLNNALMDDDKKIFFLNMPTGGGKTNTSMKLALDMVKNTDANRIIYAMPFINIIEQNFDVICKSFGLNEEEGNIRQIYSASETIFNKSDEETLEIILSDDFFNYPVICTTFVSLFNPIIKNNKKYKYRLNALSNSVIILDEIQSLPLRNWVSLYFIINELSEKYNIYFLIMSATLPSFDKLKLENIRDDDNFLNYNNVSLINNPEKYFNHDLFSRTNINGGIKKLGINDDCSIDYFLEIIRENFSQDYNKGLIVLNTIKSSRLIYDKLKDFSQEYNFDIDLLNSSILPNRRKNIIHKINQEDLSNYILISTQSIEAGVDVSFDFVIRDFSILDSIEQVRGRCNRSRELNDKFHDSNIKGNVYLINLEDDNSNLYKYIYKDVELKTRIKETINLFNEGFELNDDLNYQYSNILTYYDNVSLDINDVHDSMDQSFLRNDRRNIVFWNKMKYSKIQKKKGIHIILNDLKQYSIFIPLDIKIYDDSLNLDKTIEDMDLNELREIYDEFGKHFIFSLNEILFMKENSDFLIEGDYVIGEEVLNHFQTMVARVKDDYNQKLLVEKVFSSILSNFIMNISFNNSDLEEQIKELDKESYFYILEKNMIGDSEEHFYSEEYGFNFKPTITNIL

SEQ ID NO: 6457 - protein, 168 aa, Methanobrevibacter ruminantium
MSDYMKSINGTQINYYFICKTKLWLFSHNIQMEQESDNVSLGKQLHETSYKKEKEFLIDNLINVDFIKNKDPIEIHEVKKTQSMEISHEYQLLYYMYYLKKEKDISNTVGYLNYQNIRKQIEIELTEEKEEELETVLNDIKSIVDSDVPSPKKSRICRKCAYFEFCFA

SEQ ID NO: 6458 - protein, 322 aa, Methanobrevibacter ruminantium
MSKKNYYLLSEGILKRKENTIYFVNEKGSKPLPINKIYSMYAYGQITISSQVISLFAKEGIPIHFFNYYGYYNGSFYPRESLLSGDLLIKQAEHNIDFSKRLKLAKLFVEGAAKNILKVLAYYKIENNIKNTLTELNESSKITEVMNVEGRIRAEYYQYFDDILPDEFKMEGRSRQPPTNMINSLISFGNSMMYASVITELYNTQLNPTISYLHEPAERRFSLALDLSEIFKPIIVDRVIFYLVNKKMITEKDFNQDLNCCLLNDKGRATFVKEYNKRLETTIKHKDLGRKVSYQRLIRLEAYKLKKHVFGMKEYDPFVIWW

SEQ ID NO: 6459 - protein, 88 aa, Methanobrevibacter ruminantium
MYVIIVYDIKVERVNKVKSFLRQHLFWIQNSVFEGELTNSEYKAVTDGLLNIIEEDEDSVIIYQLMMEESLTRNVLGVEKASVDDVIL

SEQ ID NO: 6460 - protein, 233 aa, Methanobrevibacter ruminantium
MDEWKVGDPSDWGDHVGVPDIPYMGYINDDGYEEDYSTFPEENGGSKPKSLGSPEEDHGKILLVKAKVYLKWGNLDGAMSCINQAIDIFKNSRRIGYYENSLHVKGMIYEKMEQYARALFFYHKAFKVGECVSNAFDDRNKLIDGDKIDILKEQFKDYRTAYPFGSSLKRDDFIIYWDLAWRINEDSSDTEKLELALEVIGFVKRMAPSIEFVGREKELYENLEKEILEKINK

SEQ ID NO: 6461 - protein, 59 aa, Methanobrevibacter ruminantium
MGECPYCGKDVDFTEVCPHCGADLSEFDDRCPFCGVLISRAALICPRCGSDVYEFWYGD

SEQ ID NO: 6462 - protein, 58 aa, Methanobrevibacter ruminantium
MHYLEKYKLKSFRRKPKVFRRKYNPFPEGFVENFVRKSFGEILDSKMDNSNQLSKEDK

SEQ ID NO: 6463 - protein, 226 aa, Methanobrevibacter ruminantium
MEYEIQGGTFPIVVCTLQEGETMKNETGAMAFMTSGMKMDTNTGGGLLKGLGRALSGDTIFLNYFTAQRDGEQVGFSACSPGRIMPIRLDGTNTIIGQKNAFLAAEDSVDIDIHFRKSLGAGLFGGEGFVLQKFSGTGVAFLEIDGEIIKKELAPGEKLLIDPGHLAAMEESVGFDIERVKGAKNILFGEGLFFSRLTGPGTVWLQTMPISSLARALVPYLPTTTE

SEQ ID NO: 6464 - protein, 83 aa, Methanobrevibacter ruminantium
MRRIDELTIEIDQTSLELEQTKKELSILFKELRSFKKKIENGIEIDRKEYEDCVFNNKLLQMKRRRLITHLKFLNKEFYEILY

SEQ ID NO: 6465 - protein, 192 aa, Methanobrevibacter ruminantium
MDFNFHRIANEIAKIPDEKIKDLSWEDRVKELLSFRQYYNQYHESYGKDYLDFLEKANKEGDLEKKEDLIYFFKKETLTKDINLDGLNYLFVNIFLKYGFEYLDYNDTINNLKDKYDLNFKHDWISLLSKEDLSLFESINLLNYIQRSDYWDYEHMPLSYAIFDGTIDNILKGMENNLDEDNLELLDVLLKK

SEQ ID NO: 6466 - protein, 470 aa, Methanobrevibacter ruminantium
MAVYKCSVCGYEYDEEKEGKPFSELERCPVCKQPASVFEKISDNSTESDSNSNEISSNNETASELSYPTETSRTDSSIAHMSDIHKMAVEGTSIIDAMSTRLPMPSWDDILIMANQLNPFPLEEHADVSTTTVIGKNALKPMVLESPIYISHMSFGALSYETKVALAKGSAMAKTAMCSGEGGILPDEMANSYKYIFEYVPNHYSLTKENLMNSDAIEIKIGQGTKPGMGGHLPAEKITLEIAELRGKPMGEDVISPSLYGEIKSKEDLKDLVSHLRKESEGRPIGVKIAAGRIEEDLEFISYAEPDFITIDGRGGATGASPRLIRDATSVPTIYALARARKYLDENNLDIDLVITGGLRVSSDFAKALSLGADAIAIATGALIAAGCQQYRICGSGNCPVGIATQDEALRKRLDMDKASKRVFNYLNVSNEELKTFARITGHDDVHDLSVDNLATFNSEISDYTDIRHV

SEQ ID NO: 6467 - protein, 508 aa, Methanobrevibacter ruminantium
MEEEYLTVTKLNYHIKRLVNSDSSLKNVYVRGELSNFKRYPSGHLYFTLKDQNSEIGGIMFKGPASRLKFEPKNGMKVLINGYVDVYPKQGNYKIYAQKLTEDGIGDLYIAYEQLKRKLSALGWFDDEHKQEIPKFPKRVGVVTASTGAAIRDIVITIKRRWPLCEIILFPSLVQGNMAPKNIIKQIILADNEFDLDTLIIGRGGGSIEDLWAFNDETLAKVIFFSKTPIISAVGHEIDWTISDYVADLRAATPTAAAELAVPDINEIESNIKNLDDRLNKVIDKQFNENKDSFEKLVNRNLFKNPDLLYNKKIMYLDSAKSRLAVCSKNMIYDNKIRVSNVKSSLIFKNPKMLFESKSNKYNQLKYNLNSSGKILIGKKESKLDKYRNSFVFKSPNRLFESKANRYFKVRTNLEYSSINLLRDKKDNLNEIKKSNPIKNPQSILEPNEIRLDKYIDKLDVLNPLNTLKRGYTVSRVDGKVVSKAKDVKKDDILEVEFDDGNVSTKVL

SEQ ID NO: 6468 - protein, 83 aa, Methanobrevibacter ruminantium
MENIEYVESNIENLSFEESLAELERIVNRLETGEVPLDDAIDEFNKAMKLVKICDEKLNSAEEAIAKIVNENKEVVDFEVEEE

SEQ ID NO: 6469 - protein, 244 aa, Methanobrevibacter ruminantium
MVKFEIKSHDGPGRYGKLDGMESPVILKESDLNMAPDESSAYDIEREIAEWSVNETLKLAREYEDKDIAVIHGSKYIDLRVKCLKELEEMGYSGFIIANADDLLLHPRDLVDLIVELRRNMKSSSILIFPHAEAQFIPLLAYMGIDAFFDDIGEYYSYLNVLMSPTKNYDLKVYELYDLTREELEEYNKNTIDFVLREVREHMKNGSLRNLVEERSATSPQYASALRILDKEYADYLLEYSQLY

SEQ ID NO: 6470 - protein, 148 aa, Methanobrevibacter ruminantium
MVDKDLVVPRYLNQLMDIVKSYEMYIRSNIKDLDITMGEVPILLAIYDDEGLNQIDLVKKFHVTEANISKTTKHLLQKGFIIKEIDSDNNTKKLLYVTEFGEEICKELIEFYEVWKNEIISDVPNENLSIFSQVLDTFTNNSQKYFEK

SEQ ID NO: 6471 - protein, 358 aa, Methanobrevibacter ruminantium
MSVLDRLKSLIDGAKEDIDSSLTKEAESIKEAADSMQTSSEEEIENISDSETNSDEETSKVEDAEEEVIIPIHAEEAEDAPEEEAEEVPEEAEEAPEEVEEAPVEEAEEETDEEVSVEEITEEAPEEEAIEEVPEEEVSLETEEIIEEPSEEDSTEDEEPSEEEASEENEESDNMTLLKENDIYSMDDIDKEFTQKFIDAGIETVDHCFQCGTCGGGCPSGRRTPYRVRQIVRKCLLGLREEVVSDPALWMCTTCYTCQERCPRSVKIVDIIKMARNEAAKAGYMADAHKATGSFVIKFGHGVPINDKTKELRKAIGLDELPPTVHSYPDALEEVQKICAACEFDKLIGFNMETGELE

SEQ ID NO: 6472 - protein, 294 aa, Methanobrevibacter ruminantium
MEIAYFLGCIMNNRYPGIEKATRILFDKLDIELKDMEGASCCPAPGVFGSFDQTTWATIAARNLAIAEEMGADIMTECNGCFGSLRECDHLLKENPAKKDEINAILAETTDKQYKGETKVRHFAEILYNDVGLDKLSEMFTKDLGINVAVHYGCHFLKPTAEVGIEESAENPTILDELVEITGAKSVDYKNKMMCCGAGGGLRARDIDVTLSYTKEKLDAMAEAGVDAIVEVCPFCHLQFDVGQTEVNAKYGTDFAFPVMHLAQLYGLAMGLSAEELTFDAQLIDAAPVLEKLA

SEQ ID NO: 6473 - protein, 89 aa, Methanobrevibacter ruminantium
MFIAILGGIFRFKDLPEEYGSYVQFKAAIEGRDEIKDNDEIAILDITGTGSHHVLFLDRYNNINEIKKELREADAKVNVTTLKILEGHL

SEQ ID NO: 6474 - protein, 175 aa, Methanobrevibacter ruminantium
MSDLPIDQSWLVIANLSNDLHKRGIQIPKQINSDLGLVKSQIGFYKKDPTHPDMINEMARAEMSLNQIQGILLSFAENIGEDYYNEWLDKLNRANLGEKIYETPSTQSKFLINAPPGFSYAKMTLKKPLAEDRVQEIAEYYGLILEFDSDVTIALYGDKPDIQAALKEMAPFFSE

SEQ ID NO: 6475 - protein, 238 aa, Methanobrevibacter ruminantium
MKILAISDIHGKRSENLINYLKKEDISLVLIAGDITDFKLEGYDDPLDFVKPFIDELVEEADVDVFAIPGNCDPAGICNAIKESGPDEKPAFCLHNQLIAYENVVIMGYGGSNPTPFNTPGEIDDDKIYLHVYELLAEYDYIGNDSIPRVTILLTHAPPYDTKADTIESGAHVGSQGVKKPIHEFQPNINICGHVHEACSIDKVGNTTIANPGILEENHAVLIEVNEDASYNVEIVEL

SEQ ID NO: 6476 - protein, 304 aa, Methanobrevibacter ruminantium
MIIVRGSVNRKEYTSRFSKGILSRSLIRSELSPDKAYEFASRIEEDLKNKGVTEITTDEIADIVVKLLDEEEEKSVSERYLNWRKVREAKDPLIILIGGASGVGTSSMAFEISNRLGIKTMISTDMIREVMRKIVSEDLSPVIHESSFLAYRSMKVAPPPEFDFVLAGFKDQVATVSVGVEAVIERALKEGISIIIEGVHIVPGFIRKELMEKDNIVMFTLTLSDEEMHKNRFYSRCGDIWNNRPLEKYMGNFEAIRKTNAYLEDQARKEGTPIIDNIDVITTVDFIIETLTETYGGMKHVRKD

SEQ ID NO: 6477 - protein, 122 aa, Methanobrevibacter ruminantium
MSKDVLTVELDEATVFAFEKLMKHKISAMPVVDEDGKMVGIVTATDLGHNLILDKYQYGTKVKDVMVTDVAYVSSDCTIKEAISVMFEKAPGDSIINQLPVLDNGELVGIISDGDIIKILKE

SEQ ID NO: 6478 - protein, 675 aa, Methanobrevibacter ruminantium
MLLMRKKILFLTLMILICFTLNSVCAQSLDNINYANDGFDSDEMINCDLHKDSSQKSLKSNALSNKKTTNTVKLTDMKKAESNDVKQTGAAKASNTKSTSKSTTKTNATKSNTTKSTATKTTANSSSTKKATQNTTTINTQTLAKSSSSYMAYVEKNAKLQEPITISKKKYKSPEYLYLVSKAVSNISKTKVEIKDKLITNYSNTDCKSVNGTINKTEYVQVAKKTVSFIEKNHRAPNWIASSKGNIPRNQLILVFSKCLDQYNKSGKLPSSIKLNDLDLNKMKQKIDSSKKVNSTSTKKTNTSSTKTNSTSAKKTNTTSTKKTNPTATSTNNNKSLVESTLDSIKSILNNIENKLNPTNKVLSTTGTKKNTVTVNSSKVNVQISSSSTVNVKISAKDNTNSGKNTNSGSAKKTNTTSTKKTNTTSTKKIDTNSTKKTNTTSTKNNTSSAKKTNTTSTKNNTSSAKKTNTTSTKNNTSSAKKVNTSSSKTNTSAKNNTSTTAKSSSNSKYLSTSVLNDKYLGESLKKYLAVGKNCQVTNKAIKTLANTLTSKLKSDYKKGEKIFNWVRDNIGYEKYRNTKKGALKTLQTRGGNCVDHAHLIVALSRAAGLPARYVNANNCKFSSGYVSGHVWAQVLVGNTWVVADATSNRNKFGVVKNWNVNSYKLVGKYSSISF

SEQ ID NO: 6479 - protein, 557 aa, Methanobrevibacter ruminantium
MFYEKNLIKKNPLRVDIRFGLVYPNVYKTAMSSLGYQILYNYVNLRENTYCERIIYPSYRSLETNSPLGDFNIVSFSLQYEQDYFNILEILRDANIPLRRADRTLEDPLIIAGGPCATANPLPLSDFIDIFVVGEAEAVLNDLIDNYNENKDKFTNKNEFLSTFLDIKGLYISEFNNKTDIALLDEMSDAYHITCPIITETDDKDLIPVFSNSILLNVSRACTRGCRFCMSSYLYRPLRETDLQQLFDIAEEARQNTGLNKISLIGAAVSDYSKVNELTEGLKDMGFQVSTPSMRIESITRETLVSLRESGLKTLTIAPESIYHLRKRINKDISDDDVFRVIKDAVDLGFNLKLYFLIGLPYEDEDDIKELACLMKQIDSMKYLIDSNLNESIKKEEVLTKHKSKSSGKKSKSKQRKKARVSIKFSVNPVIPKPHTPLQWEGYDMKRIKSKIKYLKKNLKGLDIKFDSGKMGLIQYVLSCGDRDIGDLLEESLNRKISIKEWKENAPSYEIGDNLPWDCINVSVSKEFLESEYEKMKSGEQTPWCEDGYCYGCGACN

SEQ ID NO: 6480 - protein, 371 aa, Methanobrevibacter ruminantium
MLNPAKRVEAIELSQIRKMFEVTNENAINLGIGEPDFNVPENIREAMKKSIDDGFTKYTSNKGIIELRESIVEKLSKDNNIKTDSENIIVTTGASEALYCCAQALFEKGDNVLVPNPGFLSYYSVVNLAEANIVEVTTPMENEFKMKVEDVQEKLDKNTKALIINSPSNPTGAVMDKEDVKGIADLATDHDFYIISDEIYEKIIFGRKNYSPAEYCDNVITLNGFSKSYAMTGLRIGYMAANEEITENLLKVHQYCVANATSIAQMGALEALTGPQDSVEMMANEFSRRRDLIVSSLNDMGYPTVNCEGAFYVFPKVERPMDFVKKAAEAGVISVPGAPFGSLGENHVRMSYANSYENIEKAMDILRDLEY

SEQ ID NO: 6481 - protein, 782 aa, Methanobrevibacter ruminantium
MLFVMIAGVSASDIMDASDNPNNDDSINLVSQESGNDQISNEAISVSNSLSANDDSYSPESEKISSKIKTSNNLSASNSTKTTTKAAAAKTTKTGTSLQPSSTSIYSGQYLVITLKDKNSKALSGQKVLINISKFKNTYTKTTDSKGQVKLAVNPVGSFKLVVSYAGNGNYSSSKYSGTLKVSKSDTSLTVASTSVTMTTPLVVTLKNKKTNEALSGKKIKFVMDRVSYSRTTDAKGQAKLKVNMKYVFNVTVKFDGTGNLKSSKVTKTIKPTKIPVSFVYSANSVKYGHSITVSLKNNLNNKTLSGKKIVVKTSDSKKSTTKTTSSKGTISVPINSVGDVTVSLSYAGDSSYKAASSSKKIKGLKDSSKITSSTGTIPVGDSYTVTLKDSSGKALSNKKIVFTFDGKSYTKTTNSKGQASLAISKGPGTYSVNVSYGGDSYHSGSKLSKNVKTSNSMISIANVIKAATTLRAHVDYTNRFNKSYVVTINGLKYSPDEFAYMMSQAIVKINNGQKSGYVTFKNLTGDYDSKGSSINGNLMKKNYISLANTLISSVNKNNKIPANISTNLGKIEANLYIFGLAKALQFYGEEKYLPKYLILKNSFIKGSSSTTVTQKAKILNCKEAFNATEFEKYLKTGGKSALNSAIVAKAKSLTKGLTSDKAKANAIFKYVRDKVSYSYYSDSKKGAAKTYKTKSGNCCDKANLIVAMCRSVGVYARYSHAQGCTFSSGLVAGHVWAQTYDRATQTWYTADATSSRNSLGKINNWNTKKYSQAKNYVLIPF

SEQ ID NO: 6482 - protein, 150 aa, Methanobrevibacter ruminantium
MAKYKRVAVGGTFDKFHYGHRKLISTAFEIGESVEIGVTSNLFASNKGDVDSCNTRMANLNAFLSKSHDNFHISRLDDAYGPTIYDENFDAIVVSEETEPNAIKINEIRESKGMKPLDIVVVSFVLADDGIPISSTRIRQGKINQKGELI

SEQ ID NO: 6483 - protein, 324 aa, Methanobrevibacter ruminantium
MIFIQRDGAESRKLSYDNKVCLACGICADTCPTDSLAIADVLAIARGQAEGNNIVLDQDTCVLCGLCSFACPFGALEFDIGGQDASELPNYPKWTHESSISQDDCEFCGRCYTACPQDAILFKRELPDRNALLKGEISINEDDCIYCQVCAEICPAGAISLTASDGKILDTIEVDEDKCVYCGVCKRACPQEAIKTVCSTCMYSDEIEKIAITGDIFITEDCINCGWCKEICPVDAAEVTKPFDGEISVTEEDCVACGSCIDICSCNAVSLQDNVAVFNQDYCVLCGACARLCPQERIAINRTDMKLTNISSASWKANLEKLLN

SEQ ID NO: 6484 - protein, 78 aa, Methanobrevibacter ruminantium
MNRLPRETVFEQIKRNFVQLKDETSGQGAAEYILLFGGVIVIALAGLLIYRSYFSNNTSGLNATQDINSIRDNMSNVL

SEQ ID NO: 6485 - protein, 237 aa, Methanobrevibacter ruminantium
MEIRWLGHSAFEIISDEGVKILIDPFISNNPTCPIPVEDFEANIICITHGHSDHFGDAMEIANNTNATLVANHEISLFLGEQGFDCVGMNTGGTVSILGINITMLDARHSSSIDFTEEVRPGGDPGSFLITLEDGTKIFHAGDTGLFGDLETVVGNIFKPDIAMVPIGDRFTMNPFQAALASMWISPKAVIPMHYNTFPAIEQDPAVFSNFVYQLNPNIDVVIMNPLETYAPDFDKE

SEQ ID NO: 6486 - protein, 228 aa, Methanobrevibacter ruminantium
MRELNMDEIKNAEKIESFDQVSAKLNKTEKEEIVIDEMDIVFLLDKSGSMFGIIDDTLGGFNSFIKREKEKEVKTRVTLVLFDHKYKVLYTRKPIEEVEELTEEDYYADGCTALLDAIGTTINRIEKEVCDEVLFVITTDGLENYSKEYSREDVKKLIRSHNWNFIFIGADIDSYEEAASLGIPSTRSANYEKSRRGVGSLYRSVSYAKRLRSSGESLDKVNWKRGLD

SEQ ID NO: 6487 - protein, 220 aa, Methanobrevibacter ruminantium
MTTVAETVYKCPLCGFAHTTDCMTSTSAFGAPDLDGRPSPMARLTIYLFIKECPNCGFTSYGFPEHTSVSREFIQSDNYLNCDNIDFKTERAKLFYRVYLISKEEGMMNRALTDLVHCAWVCDDDDDEENSIKLRLLINDLFNELYDFKSDEEDYAHLIKLDFMRRGHLFDELIEEVRHKTFSKSFYNKVKDFQMEKAKNRDAGKYTFDDIEGYEEYKYG

SEQ ID NO: 6488 - protein, 669 aa, Methanobrevibacter ruminantium
MKSMTNVDINIICQELNELLAGARVDKSFQPTKDTVVMRFHKAGTGRMDLVIQAGKRIHISQYPLANPQSPPSFPMLLRKRVKGANVVSIQQHNFDRVVEIKMKKDITYTLIVELFAKGNIILLNEENEILLPLKRKQWSDRDISSKKEYVFPIEHGINPMTITEDEFKEIIKSSDDEIVRILAKNGLGSLYAEEIMLNCEINKKTLSSELTKEDILEIYGALKKVFEGLEKKEFTPMIVNNRKEIEELKKQNPDKQYKVKEDVVAIRLHQYENFEEESFDSFNEACDEFYSSKVKHEITDIQEAVWNKKVGKFSKRLEKQEETLRGFEKTIEDSQKKGELLFTNYVQVENILNVIKDAREKDYGWKEIGKTLKDAKKSGMAEAQIFESMDPLGNITLNIDGISIALDSKKSIPDNAEVYYEKAKKAKRKIKGAKIAIENTKAQLKDMEEKKEKAMANIMVPQKRVKKNLKWYEKLRWFVSSDGTLVVCGRDAGSNEAVVKKYLEQNDVYLHADIHGAPSVVAKISSDKLNNNLLKELGIFAASFSSAWSRNYGTQDVYWVEPEQVSKTPVSGEFVPKGAFIIRGKRNYIRGAKLEIAIGIVDYDGEKRIMAGPVDALKAYTEKYVTIKPGYTKKEKIAKEILSRINEDNIIELDDVVRVLPSGKCDFV

SEQ ID NO: 6489 - protein, 2879 aa, Methanobrevibacter ruminantium
MNRNSKIILISLFTLLLLAIPAGFAADIESNSHNNLDDSNTVNFEINANSKDTNLESNLNTGNLEMNSNNTNLDMNSNKARLAMNSNASDLETLGLTRGEFENGSNNPSLEYSSNSLSDNSNNKYISPSSDKNTYGSNKVGDGNVNIYYFDASASDDTGNGSLERPYKTLKNNRIVENSINYLANGVYNLDATINKNNISFIGADSSRTIISYASTAFITNNILNFENITLKGLNIQNRGNLTARNTIFIGGKGYWDRSYNNIFGGAIYTPQNENYTTIIINCSFINNTADYGGAIYACGGNVTVENSSFINNTAERFGGAIASENTLTNNIRNVEFIHDVSLNDAGGGLFISFTQLNGTDLHFYNCSADFGGGITALYSNVSLNRFIGKDNKARYDGGAIYQFYCSLLIENSLFANNSANNGGGLYVDNSNSLKVTKSNFTQNNATEKGGAIYSLWNTLAEGNSISNTRFNNSFSNNNAKNYSNFYEGKDVNMRIGSGNVTLYHRNETEIDEIPSYYSLIDLNQVTSIKNQQSGGNCWAYASIAALESAIIKAGGEALDLSEESMKNLIVLFSDYGYPWLTNNGGNGDFANAYLTSWLGPVFEDDNPGDDRSYLSPVLNSRIHVQNIQYLGRNNYTDNDRIKEAIMKYGAVATSYYMDNSYYNYRTSAYYCPSATSSNHAVAIVGWNDSYSKSNFKTTPQGDGAWIVKNSWDTNWGDNGYFYVSYYDILIFPLGSMDWGHAYVLNDTIKLDKNYQYDISGLTDYFYNASSTAWYKTKHTADEDEYLAAVSTYFLTTTDYTIFIKVNGEELYNQSGNSEYGYRTIYLNDFIPLKAGDVFETIFKINVSGETGIPVSEGSAFNKVLYDRNQSFVSYDGINWLDIYDIYWTYNSDVYGSHYYVSAALCLKSFSFINEIGTNLTLEFNYSLDNEGDRISPVNIIAHVINEYGFNLDNGQVKFIINGTETIADLINGYANISWNFTDIENEVYALFEKTGYLSSSANETATLSEKYVTLDLNTLLSEDKLTITVDSSRKINETLILEINGEKHPFNLSEGHVVYDLYDIEDIDYLIRAYLNDTGFYNCEEKSTIFRLNTEITEIIASNFTTDDYSNAIYEISLVDSQGIGIANKEILFNISGNLTNNNNNNNNFNNIIFNLTTDNDGKARIPINLPGGNFTINVQSKGNYLYSSAEVALKLKVKDKVRLDIDLNLNFNDLEVIIELNRSLNETVNFSFAGESSIIRLENGRASVNFTGLSNNNYTAIAYLENDIDYLSNIAQKTIEINIRNLIIQADTINTTNRYYGNYTILLTDEEVNEVANKTLNVKIGEESFNKTSDNDGKVIIPLDLGIGEYEVIISFNGDKDFFKANATRTITVLEKLFANITVSTLVDEATIDIIIDKKINETLNISIDQSEYPVLFENGTGQLILDGLEEGNHIVTIDLLKYLLFESKEFEIDKSINLSSDDFNCYEHTNSTYTVLLTNNGKALANKTIRFVLNDTTTIRNTDMEGKASIDIDLSPGVYELNITYYDDERSVINTVYVLSNITNSTDPKFNVTLDMDTVLSPDKLTINVNCSKKINETLILEINGDQHFINLTDGFVSFDLYELEKIEYVITAKLNNTDLYRFEDKSVNFELNQEATDIIASNFTTGDYSNERYEITLVDSEGIGISNKEISFNISNSLMSNENYIIFNQTTDNSGKASIPINLARGNYTIKVQFKEDYLYLASESTVDLKVKENVKIDIEFKQMINDLEVIIELNKTLNETVNFSFAGESSIIRLDNGKFSINYTGLANNNYTVIAYIENDTNYHSNIAQKTIEINIRELIIQADTINTINRYYDNYRILLTDEEGNGIAGKTLDIRIAEGNYIETSDNDGKIVIPLDLGIGEYEVNILFNGDNEFFKANVTKTITVLEKLFADISISTLVDEATIDIIIDKKINETLNVNIDQTSYHVIFENGTGQLTVDGLDEGNHIVTIDVLRYLLFENKEFTIDRSINLTSDDFNCYEHTNSTYTVSLSNNGKVLANKTIKFILNNQIILRNTDSEGKTSIDIDLSPGVYDLNIIYYDDERSRTNTIYVLSNITHSTDPKFNVTLDMDTVLSPDKLTINVNCSKKINETLILDINGKEQILNLNDGFVSFDLYELEKIQYVITAKLNNTDLYRFEEKTILFELNQESTDIIASNFTTDDYSNAIYEIRLVDSYGLAIANKEILFNISNSLMSNENYIIFNQITDNSGKASIPIYLPGGDYTIKVQFNEDDLYLSSESNAHLKVKDKVRIGIEFNQNMNDLEVMIELNKPLNETVNLIFAGESSNVKLENGKASLKFTGLANNNYTAVAHLENDRDYISNIGEKTIEINLRNLIIIADSIKTKNHYWDDYTILLTDEEGKNVANKALNIKIDANSFIKTSNNDGKVIIPLDLGLGMHEINIAFDGDNEFFKSNITKTINVIEEISVNVNISTLVDNALIDLKFSKDLNEKIDVLIDQNLYPVSLEKGAGQIRVNGLEEGKHILTVDLPEYLLLESEEFEIDKTITLISDDFRCYEHSNSTYTVVLENNGKALANKTIKFDLNKIVTIRTTDNNGKAYLNINLSPGTYKLNIAYYDNGRNKIHNIYVLANTSGDNKTNETNSSSNTNPINNQTNNTNPTNNTKPINNETNNTNPTNNTNTTNNTNTTNNQTNNTDPVIVRKGTNILCQNMITTAFDSKVDGRIGKYFVVTLVDADYKPMADKTIYIGFNGKKYIRTTDSSGQAKLQINLAYEGSYTFAIAFLGDDDYKGSFVVANIKVNKQIPQLKSSDRTYRSIAKTKTLTASIKTAQGNAITGKKVIFTINGKKYTAIINSIGIASVKVSLSKKGTYRFTVQSEASSTYASTKVTHKLVIK

SEQ ID NO: 6490 - protein, 605 aa, Methanobrevibacter ruminantium
MSSMSSVAGLSKYIRTLPKAKSTFLMIIVLSFIIGAVLFLVKPMSLGSGLENFFYGGAFGFVVYGLPAIITGATDQKWVSTLKGINLKMKHSMFLALVSMTMAGVISIIGTIIGNILHFDLFINSILFGIVIAFAFNILVIWSVTRIRLIKSVLVAIIQPLLMIGVLIITSFLNNLESVFELGIFTTFFKVIIASAVFLLAIYSFISIVESPMKKNLGFGALEILSFFISHMNEGSKSIEELFDNAGEAIDTLVGVCSFRKPDGDIKALFISPCVHPGPLGDIGGSNMPTILANRFDSFAMVAHGPSTHDFNPVSSDEIVKIESSVRTALENMEYSSKASRFVRYSHKKANIGTQFFNNGCVMLSTFAPSGSDDIEFAVGLATMIESQKELEIDNPILVDCHNSFNAEKGGVLPGNPELFQLLDTIKLIEKKDLEHEIKVGCYSTDLGGFGKHEGIGDSGLKTMVIEVDGQRTAYVLFDSNNMELGYRETIFNAVEDLEIDEIEVMTTDTHSVNTLSAGYNPVGTVEKEKIIEYVRESIIEAIDDLETVEAGTRTERIENLKTFGPNNSTELISTISSIVSVSKIAAPLIFIMAIIFVFIWIYLF

SEQ ID NO: 6491 - protein, 176 aa, Methanobrevibacter ruminantium
MIELKTPITDDDIDKLKAGDVITISGQILTARDQAHKRILEQGAPLDIKGAVLFHAGPIIKEESDDAQTKYEMVAVGPTTSMRMNPYEADVLDMGAKIIIGKGGMDDTVREALKRNNAVYVVATGGCAALYVDKVKEIKGVDWLDLGMPEAIWDLDVESFGPLIVAMDSDGNSLYD

SEQ ID NO: 6492 - protein, 2065 aa, Methanobrevibacter ruminantium
MKLKYLMFIGLLLIGLLIIPISFAGDADSYSAYSGDSISLEDDNSYLESNTVLKDSKNSLQSIDDDCLIGNRTLDDTSYSDSTNSEDLTNPDSTNPDSTNSEDLTNLESSANTDSSSEIKTITKSLNDQNTNIKSLNYDEYADYINLNNQLINYDFAISDSNTIFVNASYTGSTENGSQASPYKSIYSAYNYAFGLSSDTRTNVYIAKGVYTVTRRMTINKNLNLIGEDSLNTIIDCNGNGAFFISPRRSYTTVYSPLLNIFNLTFTNGRYSSGGAIYINESTVNFVNVIFKNNRAEASYYGSVEGGALYNNKGFVRIYNCLFENNTANDTSDACGGAIYNDMGEMTIMGSQFINNTAKGENAAGGAIYDFSGILVIFNSTISKSSLLSNYSMGGGLASWSSHNIFIINSTFDSNEGHGKYVFGSAIANKAIMMYIENSTFSNNLANGTSDKNGTFFHLNGVLDFDNVNFTNNRAINPKEDILICLEDQFIISEAFSQEDIAEILSEMELSQLPSSYDLRDYNLVTSVKDQKNSGSCWAFSTLAALESYLLKYENTSYDLSENNMKNLIGAYGLNGTDWYDGGNHYMSLAYLLRWSGPVNESQDPFNDTSHNSRTFTNIVKQVEDVLYVPLRLNYLDIDQIKAAILKYGALYTTLCSDDSFDNNPDYYCDVISISNHAITIVGWNDSYSADNFAVRPPGDGAFIIKNSWGPSEGYDGYWYVSYYDKTLAGYGYDAIAAMAFTSVANASTYKNNYQYDTLGNTFESIGYGCSTAWIANQFTALNNNPLAAFGLYTYGSSSYLVNITVNGISRLVQEGNVKGAGYHTIKLDDVVELLSGDIFKIIVKLSTPDSNYPVAIESKRSDYSSRANSNPGESFISFDGQNWQDLYEVGDILKFYMYMNNKTFTEPNICLKAYTIGPSDVHLHARANATTYTQGDTVEIKITVSNEGATVNDLNISMKWNSSFFLKSFTKLNGEFDSTKKIWHFDTFSEGQSSTLTLVFTMRGNNDVASLSYDYNYSGFNPGDANTTQVLNLYYGSLTKFVEVPNVSTSVKSGDVVDIQLTDLQSIGISDKQIVISLLESDNEYLFENVTLITNGSGQAGFVLDLLEGNYVFLASFAGDDSYMSSNVTFNVSVSKSNTSISLDNLDPSNITVFSKSGDVINFTLSDGINNLSDKNIVISLIESDNDYLFENLTLITNGSGQAGFVLDLLEGNYVFLASFAEDGYYKASNLTFYLNVLRRASSMEFDSSSLIYNGSNWISLSQSNDLIEFILSNQTGPLADKTIILTVEDLNSVDLAENPLIYNLTTGPNGIASFNLNLTKSNYEIIASYLGDECYSPCEFGFNLSVLKRNAPHIVADDIAINSSNPYQAHLLDDDFNPIANQSLLFAFAKKDSQDLFNYSAITNERGIAIIDLSDIESGDYNLLIAFESNDLYDDSILEIDVSVVNDSLNGDNGTNDTGNGTNGTDNSSKINTLFKIDMSDLTVSANVDKTIEFALLDESLNPLADKTLNLTIVDLDEDTELITDSDGIASCVLNLDEGVYEFVLSFSGDENYSPSRLIFNLSVSKADNGTSPGGDNGTSPGGDNATNGTDPSGGNGTAPINDNGTNGTDPSGGNGTSPGDNGTESSKINTLFKIDLSNLNIFANLEKVIEFELLDESLNPLSNKTVGLTISNLDGVSLITDSNGIASCPINLDEGVYEFALKFLGDDDYSESAMIFNLSVSKRIAQLLSGETLINLSSEKREYDVYLVDDKLSPLANETILFALSSMDGQVLFNYVVKTNDEGKASLSGLAKLNESNYIVKTEFASNDFFEGAELIKTITLIKDAPNGDDANDTNGTGNQTDNGTDTGNKTDNGTDTNGTNGSDVPVSRKATKIIYEDMVTQSVVPDVDGRIGDYFYVTLVDGNNNPLANKEVKIGFNGRIYNRTTNATGGVKLQINLKMPFTYTFAICFLGDDDYNASFEVAKITVNKKKMSLTAPSKTYKSTAKTKALTATLKDNNNKAVANKKITFTVNGKTYSATTNSKGVASVNVSLSSKKTYSFTAKFAGDACYGAVTKSGKITIK

SEQ ID NO: 6493 - protein, 105 aa, Methanobrevibacter ruminantium
MADIGEAAEKKLKSRIRKLKKCNKDEEEKVKFFNQLGLSFTISLPTKNPEKQEDFIMLYTTPEGHIVHAEYSYSEGEEFASMDIPEKDLKVIIESFSDYELKLLD

SEQ ID NO: 6494 - protein, 380 aa, Methanobrevibacter ruminantium
MIVNNSLDELKKRESALKIIRSIVENEGRSSLYDVTGLSGGFISSEEELDLLETYVGPAIFEDELQVVAKEHLGGEKALAVNRTSSGILASILSLVKEGEHVSHFLAQYPAHPSIPRSCNIVGADYDEYIDLNEFKIEDNTSLVVVTGSTMDHQVIDEDTFKEVIDMAHDKDIPVLVDDASGARLRTAVFNQKRACDLGADLVVTSTDKLMPGPRGGLMAGKEELIDKVKVKANQFGLEAQPPLILAMVNGIKNYSEDNLINAISRKDKFYDMVSKDYEMFEKTPTGVMVTEDALKKQVDALDIETELSEKDLSFLWAMILLKDEGIITIPAVGMPGASATVRFDLSTQDVIDMNLGILHDKVDDSFNKFFRQLSRCGKV

SEQ ID NO: 6495 - protein, 303 aa, Methanobrevibacter ruminantium
MKREMIKLLVSYDIISKEEAEKIDSINDEAIEESIKELGFGKTEHITKERISEFLETEELGEEILCFRKVFSTNSISKFLANHGAKEGTVLISEIQTNARGRSGKKWEAPDGGVWMSMILRPDVPPAKIGLITLATGVAIARAIRSFDVDAKIKWPNDILIHGNKISGVLTEVIATFNQIEYVIVGVGIDSNLKLEDFSEDIREGTTTLEEEIPVKVDENELIGIFLNEFEKIYDIYLNGDVEEILSEWRALSDTIGKYVSITQTGGKTTQGYVVGINKEGSLIIEKQDGNLEKIISGELRTL

SEQ ID NO: 6496 - protein, 497 aa, Methanobrevibacter ruminantium
MFEKVLIANRGEIAIRIMRACRELDMKSVAVYSDADKTSLYTNYADESVPLGNPSPSQSYLNIEKIINAALDTGADAIHPGYGFLAENPELGRQCEKNGIKLIGPKGEHIEKMGDKITSKQLMKEAGVPVIEGTPEGIDDVEEAKEIAEAIGYPVIIKASAGGGGIGMRAVYSEEELVRALEATQSVALKNFGDATVFIEKYLEKPRHIEFQILADEYGNTIHVGDRECSIQRRHQKLLEEAPSPIMTEELRERMGESAVKAAEYIGYNSAGTVEFLYDNGDYYFLEMNTRIQVEHPITEIVTNTDLIKQQIKIACGEELEYSQSDITVTGHAIECRINAENPLADFAPNPGKITGYRSPGGPGVRLDSGVYMNYTIPTFYDSMISKLVTSGRTRNDAINRMKRALSEYIILGVKTTIPFHKAIMRNESFLAGDLNTHFVDEHKKGIEEEMEKVILEDLERVNRMKSTFMPGKKIAAISATVGTYFNAAQAQQMKKK

SEQ ID NO: 6497 - protein, 39 aa, Methanobrevibacter ruminantium
MISIKIVINPSFDMVKSTLKEMIKFSLELMKIFIMVLFA

SEQ ID NO: 6498 - protein, 276 aa, Methanobrevibacter ruminantium
MIFNYSSVIMKIRKKKQLEMILQNVPSHPNPKVELEQYSTPSSIASDLIWNAYTLGDISDLSVLDLGCGTGIFAIGSWLMGAGYSLGLDIDPESIALGEKTIIDLIGLNQPSDVDVFNINFIVGDINQYNSISELLNDKSIQSDEKYDKLIEYYNSNSLGDDSNLNNSNDGLMNGSFDEKDFKFATLFQNPPFGSQERGTRHADRKFMEFAMASAEVIYSFHMKSTEEFVIDYYNDLGGDISHKFVYNFPLPKIYDFHKTESRDVKVVVLRVENFK

SEQ ID NO: 6499 - protein, 271 aa, Methanobrevibacter ruminantium
MQNSKVSVFIPNSFLAETKDLKLKTSKVGLIGRALAVFEVDEVVIYKDLSIPDSEQTDDGDFIAEVLNYMDTPQYLRKKAIPIKAELRHVGILPPLRVPHHPTGKPELGDYRQGFTVKRNKKGTFVDIGMDKLAFCKEQLTVNKIFSFKITKFAKEVIVTPDEPDDIYWGFKTLSTNKSLKNSLKLVNPDLVVETTRYAETIDSIFNELKTKVESSNHIAIVFGGPYSSISENVESSKWETVKINTIPNQGTETVRTEEAVISTLAIFNIL

SEQ ID NO: 6500 - protein, 336 aa, Methanobrevibacter ruminantium
MVRHHQPRKGSVAFSPRKRVAKETPRIKAWPSNEEPKLLGLAGYKAGMTHAMVVDNDKNSPSHGMEVFTPVTVLEVPPLVILGIRSYEKTAHGLKAITEVIADNLDEELSRKITLPKDYDQSEAIAKIQDALEKTEEVRVLVHTNPKMASVPKKKPEIFECALGGSSAEEKLNYALGILGQEIRASDIFSEGQYVDAIATTKGKGVQGVVKRWNIRIQYGKAMRSGKGRHVGSIGPWSPERTMWTVAQAGQMGYHKRTEFNKKVIKIGDVSEVDAVNPAGGFIRYGLVKNDYVLVKGSVPGPTKRLVILRQAIRPKKADDAAPQVNYISTASKQGV

SEQ ID NO: 6501 - protein, 254 aa, Methanobrevibacter ruminantium
MKVNVYSIQGEVKEEIELPAIFNEEYRPDLIKRAVLSAQSARIQPWGNDPMAGKRTSAESWGSGRGAAMVPRIKTGARAAFVPQAIGGRKAHPVRAAKNHHEKINNKERRFAIRSAVAATVNEELVAGRGHRIENLEQVPVIVEDDLETVKKTSETREIFKALGVYDDVIKAKDSKKIRAGRGKTRGRKYKSGKGPLVVVSEDKGIGLGARNHAGVDVVAVDNLNAELLAPGTHAGRLTIYTKSAVEKLGGLFQ

SEQ ID NO: 6502 - protein, 86 aa, Methanobrevibacter ruminantium
MDPYTIIVKPHVTEKTMNLIDQNNELTFVVRRTATKSQIKRAFEFLYDEKVVRVNTHITSKGLKLAYVKLAEEGEAEDVAVKMGVF

SEQ ID NO: 6503 - protein, 241 aa, Methanobrevibacter ruminantium
MGKRLIHQRRGRGTPAHRVASHRFKDKIQYRAYDDLEKEGSLKGKVVKIIHDPARTAPIALVKFENGEKRHILAPESIQIDDEIECGISAPISFGNTLPLAEIPEGTPIYNIENRPGDGGRFVRSSGTYASLITHDASQAVVELPSGELKSFNPRCRASIGVVAGGGRKEKPFLKAGVRWHAYKAKGKKFMTVRGVAMNAVDHPHGGGNRQHPGRPTTISRHAPPGRKVGSIAAKRTGKRR

SEQ ID NO: 6504 - protein, 136 aa, Methanobrevibacter ruminantium
MARKIFKYRGYTIEELKEMSLDEFIELLPARQRRSLKRGFLPRQQSVLDKMRKMQKMDKKGGKPLVVRTHCRDMIVIPEMVGTTFGIYNGRDFVEVTFTPEMLGCFFGEFAPTRARVQHGDPGMGATRSSMFVPLK

SEQ ID NO: 6505 - protein, 155 aa, Methanobrevibacter ruminantium
MAKNKYAYNNPDADESKTARAMAKSIKVSPKHCVEICSAIRGMDVAKAKAYLNDVIDMKKAVPFKRHNRDVGHRKGMKGWAAGRYPVKASKAILTVIENAEANAEYKGMDVENLKIEHISSHRGMVIRGARPRAFGRVTPFNTPTTHIQVVLVEA

SEQ ID NO: 6506 - protein, 251 aa, Methanobrevibacter ruminantium
MIEKDFVTEGLRRTRIDEYLEKELERAGYGGMEIQVTPLGTMVIVYAERPGMVIGRGGKTVRAITQSLKTKFDLDNPQVEVKEVAVPELNARIMASKIANMLQRGMHFRRVAYSTIRKIMGAGAQGVEVTISGKIRGSRSAVAKFTEGYIKKCGEPATRFVTEGFATAPLKPGVLGIVVRIMPPEATLPDKVDIIAPVEVEEPVVEAAEEDVEEIEEEVTEEIEEVEEDLEELEEELEDLEELEAAEEDVE

SEQ ID NO: 6507 - protein, 68 aa, Methanobrevibacter ruminantium
MAILRSKEIWEMEIEDIEEKLVELKAELAKNVSKSAAAGVNENPGKIRELKRTIARVLTIMNQKQKEN

SEQ ID NO: 6508 - protein, 114 aa, Methanobrevibacter ruminantium
MSKICDVCGLPEELCVCEEIAREVQSVKVFTVRRRFGKLMTIVEGIDEHDIDIKELTKTLKAKCACGGTAKKGQIELQGDHKARVKEVLSEMGFSSDTIEIRDSDKKYNKRRRH

SEQ ID NO: 6509 - protein, 111 aa, Methanobrevibacter ruminantium
MISSNNIFYHELIGLELKVVDSSNPSLIGLCGTVIDETKKTLLIEVEEKVLSDDLGSNQQNHFNLIYKEKLIQKDVSVFQFKVPDGTIVEIDGKILLNRPEDRIKKRYKKI

SEQ ID NO: 6510 - protein, 106 aa, Methanobrevibacter ruminantium
MVGLNVKEPETKCDDPNCPFHGNLSVRGQVLEGVVTTNKAERTITVERSFYKFIRKYERYEKRKSRINVHKPDCIDVEVGDAVKIAECRPLSKTKHFVLVEVKGDD

SEQ ID NO: 6511 - protein, 132 aa, Methanobrevibacter ruminantium
MKPTTSSVTKALPIGARLQCVDNTGAREIEIISVKGFKGVRRRLDVAGVGDMVVASVKKGTADMRREVVNAVVVRQKKEYRRADGLRVKFEDNAAVIITPEGVLKGSEIRGPVAKEAADKWPSVGSAASILI

SEQ ID NO: 6512 - protein, 113 aa, Methanobrevibacter ruminantium
MSIQPRKQRKALYTAPLHIRRKIMSANLSKELRADIGKRSLPIKVGDKVQVVRGDFKGHEGKVESIDAKRYKVTVEGVTLNKPDGNAVFLPIHPSNLMIIEADLKDERRIKEE

SEQ ID NO: 6513 - protein, 244 aa, Methanobrevibacter ruminantium
MAKMGSRKHLKRYNAPKTWPIHPKEDTWTVKPAPGTHAINDSLPLLVIIRDILGIADNSREAKRLINTGNVLIDGRAKKDYKFPVGFMDILSIPKTGENYRILLDTKGRLTLHPISAEDAEFKLAKIVNKSTIKGGKTQLNLHDGRNVIVEEDNYSAYDVVCLNIPEQEIKENFEFGEDVVVLVTGGKHTGELGKIQEVIVDQSSKANTVIIEKANKDTFLTLKDYAFVIGKDEPAIDLLEVNQ

SEQ ID NO: 6514 - protein, 173 aa, Methanobrevibacter ruminantium
MNPMNEVVIAKATINIGVGEAGEKLSRAMTLIENMTGQTPVKTYSKVTNPEWGIRKRQPIACKVTLRGEKAEDAIKMVLDGINNRLRPSQFDAQGNVSFGIREHIDIPGMRYDPDIGIFGMNLSITFEKPGYRIKRRKIQKKSIPKRHRITPEETMKFMEENFNVTIAEEEEY

SEQ ID NO: 6515 - protein, 50 aa, Methanobrevibacter ruminantium
MIVLPRKYGKASKKCSRCGDHSAIVSRYGLNLCRQCFREIAPKIGFKKYN

SEQ ID NO: 6516 - protein, 130 aa, Methanobrevibacter ruminantium
MTLMDPLADALTNIRNNERQVNDHCTISPASKLIGRVLSTMQKENYIGEFEFIDDNKAGKFEVELEGNINQCGVIKPRHAVKKDEFEKFEKRYLPAKNFGILIVTTPEGIMTHREAKERGIGGRLLAYMY

SEQ ID NO: 6517 - protein, 177 aa, Methanobrevibacter ruminantium
MVLAAAIREEIEIPEGVEVIIDDEISMKGPNGEISRKFTYPNVTIKKEDDILVLETAFPKKKDKSMIGTTRAHLNNMIKGVTEGFTYHMKIVYAHFPMTVKVEGDKVTIDNFIGERHPRSSKIVGGANVQVKGDEVIITGVNKEDVGQTMANLEQATKIRGKDPRVFQDGIYLTSRE

SEQ ID NO: 6518 - protein, 114 aa, Methanobrevibacter ruminantium
MVILMSKDFKRQEYARYKKLGTKWRRPRGKTSKMRRYEAGKPAMPSIGYRTPRATRGLHPSGYKDVLVYNMKDLEALDAETEAARISASIGKRKKALMLEKASELGIKVLNRQL

SEQ ID NO: 6519 - protein, 148 aa, Methanobrevibacter ruminantium
MNLTTQRRLAASILKVGVNRVWIDPEEVEEVSRAITRDGVKQLIDQGIIKARPKTGISSYRSKKLKEQKKKGKRKGRGSVKGAKNARTPKKQVWMKTIRALRSDLKEMRDTGEIDPTTYRKLYKMAKGGAFRSKSYMKTYARDHDLIK

SEQ ID NO: 6520 - protein, 193 aa, Methanobrevibacter ruminantium
MASGSNYKVAFRRRREGKTDFAARAKLVDVDKARLVVRISNANCIVQVINVGLTGDETVVSAHSKELNKLGWKGGNKNTSAVYLTAYLCGKKALAAGVEYAIADIGLKSPIKGAKVFAAVKGAADAGLDVPYGESIIPSEDRINGEHIAAYAESLDEDELNKKFSQYLARGLQPTDLPQHFEEIKNKIDEAEV

SEQ ID NO: 6521 - protein, 213 aa, Methanobrevibacter ruminantium
MSFNMDDWEPKTNLGKEVKAGNITDIDEIFEKGLPIMELEIIDALLPDLEEEVMDVNLVQRMHKSGRKVNFRVIVAVGNRNGYVGLGQGKAREVGPAIRKAVDNAKYNVIKVRRGCGDWGCVCGRQHTVPFKVTGKASSVKVTLRPAPAGVGLAIGDVGKTILSLAGYKDVWSQASGQTQTTVNFANAVFNALKESCKMKASEQDLKNMGVIQ

SEQ ID NO: 6522 - protein, 152 aa, Methanobrevibacter ruminantium
MYLVIRVRGTTGVIQGIASTLEMLRLNRINHAVLVEENPSYKGMLQKAKDYITWGEIDAETLTEIIEKRGRLVGGARISEEYLAENTDYSSFEELANALLNGELKAQDINMKPVFRLHPPRKGYEGIRHSIKEGGSLGYRGEDINSLAKRMA

SEQ ID NO: 6523 - protein, 147 aa, Methanobrevibacter ruminantium
MIRKGKKINKMRGSRSNGGGSVKRRRGAGNKGGKGKAGAGKHHWSTTVIENRYYFGKHGFKRPQKTIHRSYPVNLNFLNDKAEEFLEKGIATKDEDDVIVIDVTDLGYNKVLATGSLDIPLVVKSPAFSEAAIEKIEEAGGEAVELF

SEQ ID NO: 6524 - protein, 456 aa, Methanobrevibacter ruminantium
MFLENFKPIFQLLPEVKTPIHRQDFREKLKWTAIVLVLYYFLTLIPLYGLSPAAVDQFAQLRAVMAGSFGSILTLGIGPIVTASIVLQLLVGAKILDLDLTLHEHKAMFQSTQKLLAIIFTIFEAGVLVFTGSLVAIDPSFYPIMLLQLVIGAIMILYLDEVVSKWGFGSGVGLFIAAGVAETIIVGTFNFLPASAASTTASGILPAFIQSIIGGAPNFQILIPLIATIVVFLIAVYGESMRIEIPISHGRVKGHGRIRGAVGKYPLKFIYASNMPVILTSALLVNVSLIASLFQKLGFPIFGEVSGGRAISGLALWLTTPNSISVLFTNPLRVLFYAIVFLGCCVLFSWLWVEISGSLSAKEVAKQLYNSGIQIPGFRSSKRQLYTIMKKYIPALTILGGLFVGILAFIADLTGALGGGTGVLLTVGIVYKLYEEIAQEQLMEMHPMLRKFLGND

SEQ ID NO: 6525 - protein, 185 aa, Methanobrevibacter ruminantium
MKLVVLTGIPGSGSTTVLKKALEEVDYLHLNYGDIMTEIAVEKGLVETRDELRKLPADTQKEIQKAAGIRIKEKSESENVIVDTHCTISTPSGFLPGLPKWVLEGLNPDHFVLIEAYPDEIRVRRTNDDTRQRDAESAEAIQLHQEMNRAASMAYATLTGATVKIVYNHDNELDDTVAGLVEFLK

SEQ ID NO: 6526 - protein, 88 aa, Methanobrevibacter ruminantium
MPANRFRSRSYKRTNTKTPGGVNVLRYKKKKPSKHVCAECGAVLHGVPRGRPFEVNKLAKSKKRPNRPFGGNLCPECTRKHFKQEARK

SEQ ID NO: 6527 - protein, 172 aa, Methanobrevibacter ruminantium
MIITIGGVAGSGTTTAAKVLSEKLGVPYISAGAIFREMAEEHGMTPVEFGKFAENNTDIDKEIDNRQAKLAEEADDLIIEGRLSAYFIDADLKVCFTAPLDVRAKRVCERENKSVETARLEIIAREESEAIRYRDIHNIDIKNMDIYDLIINTNSFDPESISEIIITTLKVI

SEQ ID NO: 6528 - protein, 55 aa, Methanobrevibacter ruminantium
MAAIEVGRKCIKTAGREAGKECEIVAIIDENFVEVKGDEVKNRRCNINHLEPIME

SEQ ID NO: 6529 - protein, 837 aa, Methanobrevibacter ruminantium
MILVFKMGIFDKVKSAFESSKNFKYLDDLIHSGLNEIVLDDDISLSKNEKNKYSNGIEIEIDNLVIDGNGHAIDAQGNGSIFLCTGKNIVVKNIHFKNGIHSNGGAIENRGELTIMDSTFDGNNASLGGAVFNDGPKLMIAKSTITGNIAKEGGGAIYNNDGEVYISESMINENVSSFHQYSGGAIYNKGELTIEKSTLIRNHASFGGAIGNIGQLNIIDSTISNNESSGDGGAIFNDNASLSISNSMIEANVSDGLEGGGAIYNKEGELNITGSVLKQNELVGQIGKGGAIYNNGGNLNIAGSSLCNHSINFFGGAIYNDGGKINIAESKFNENSSNRNGGAIYNEGEVNIRKSSIKKNKSDGGVIENINGDFKIFNCEFFSNESQGNIIFNQDSLEINYTDFKDNRSKSMLLNDGVKSKMSLVKGEINGNDVKDTLILNEGNSLTISETVFENNLIPNGDAIVNSSNLILTNPKINDDNQEIRNQGNLLLKRSSLDIKGKINGEGKIETDDHSNEDKFDFGYLDSLIHGSPDKEIVLDKDIKLENYEVDFYEGGIELDFDDLIINGNGKTIDARGKSRIFTISGKNITLKHITFKNGHSYKNYDNPLNNNGGAIRINANANLTITDCKFLDNLSEDYGGVIYYNGSGDLVLTASTMKGNTAENDGGAIFSSGEVKINKSKFINNSGNNGGAIAIVNSNDKASVTESIFNENAADSKGGAIWFHNSNIALADCTFNDNYATCGAAIYQEISKGSISNSTFKRNLSSYAYWHDGKLVTNKNHAIFIDTGSGLNDFNQDRDNIINCDFIDNNNNLYAQKHDLIKSRLDEHLALWKRNL

SEQ ID NO: 6530 - protein, 277 aa, Methanobrevibacter ruminantium
MLEVRNIKYSYNKDYQALKGVSLKVEEGQMVALLGKNGAGKSTLFLHLNGIYEPDEGQVFIKGEELKYDKKSLLKFRQKVGIVFQNPDDQIFAPTVEEDVAFGPLNLKLPMEEVQKRVTEALARVGMSGYEKTAPHHLSGGQKKRVAIAGILAMKPEIMVLDEPTAGLDPQGVTALSNLLKELNDEGITVIISTHEVNLVPTYAEKVFVLVDGELVAEGTPKEIFAQPEILEQANLEVPIVTELFQELEKEGYDMNDDYPLTIDEAKEKFLELLNKN

SEQ ID NO: 6531 - protein, 230 aa, Methanobrevibacter ruminantium
MKFDMDYIAHHNELSEANPYYKLFITIILLIVTLALDNLYFDIFMFILFSIIILGVAKINIRSYIKFLTIPMAFLIITCLFLIFFFGSGKVIYQTGFFGIVVTDDSWHYGLYTFFRVLGCFPILGFLALTTPIAKIFHCLETLKVPKIVIEIGLLMYNTIFIFLNEIDVMQKAQKTRLGYNSYWNSLQCLGSLVSNIFLRSLEKSETLQNSLDSRGYDGELPVYIPPKEE

SEQ ID NO: 6532 - protein, 228 aa, Methanobrevibacter ruminantium
MEKGKLYGVSIGPGDPELITVKAMNIISKSKYIATPHTGTGESLALSIVSQAIDLSNKEIMLLEFPMTKDKDILTKSHNEAAEAIIKVLDSGEDVAMLNLGDVTIYSTFDYTKDKLVERGYDVQVIPGVTSFCASASELKIGLTTMNEPLHIIPASGIDIKEALKMPGSKVFMKIGRSMPKLIEAIEELGLQDNVYAVENCGLENEKVYKGLKEFDEKMGYFTIVVVK

SEQ ID NO: 6533 - protein, 379 aa, Methanobrevibacter ruminantium
MQDKRLVNQQLLRCGYTTGTCAAAASKAATTMLFEKERVDSVSITTPNQTSLNIDVLNPQLTDKKACCCIQKDSGDDPDITNGILVSAEVSLTESKGINIDGGKGVGRVTKPGLDQPVGNAAINSVPRKMIEDSLNELARHYDYDGGFNVIISVPEGEEIGKKTFNPELGIVGGISILGTTGIVEPMSAKALADSIKVEISVIAAESNESILIFLGNFGKKFTEEELKLSTSPGIMCSNFIDVALDSSVEYGFKNILLIGHIGKFVKLGIGLFNTHSHNGDGRIEALLSCALEAGADLETLKAINACVTTNAVLDILYEKELLDKTMEILNDRIQHRIDKRVPPEANIGFICFANSGEYEGILFESDNAKELMTIWKTD

SEQ ID NO: 6534 - protein, 251 aa, Methanobrevibacter ruminantium
MIHFVGAGSGAVDLITVRGANLLKEADVIIYAGSLVNPDLLNYAKDSCEIYDSAKMTLDEVLDVMFEAEKENKMTVRLHTGDSSIYGAIREQMDRLDEVEIDYDVCPGVSSFCGAAASLKAEYTLPDVSQSVIITRMAGRTPVPEKESIASFAEHGATMVIFLSTGLLKDLSKELVKGRYTEDTPAAIVYKATWPDEKIMHCTVGTLYETAKENNVTKTALIIVGDVLDSEYSLSRLYADDFSTEFRQAKK

SEQ ID NO: 6535 - protein, 340 aa, Methanobrevibacter ruminantium
MKISIIGFTDNGMEIAYKLSNSLSEDNNISFTRCGKGELSIWTEEHFSDSDALIFIGAIGIALRAIAPYIKTKTKDPAVVVVDELGQFSIPILSGHIGGANELALQIADILNAIPVITTATDINNLFAIDTWAKSQGLKILNPECIKLVSSKLLKGETIHIKSDYPIQGNLPKKVQINDLEDSNSDYDVIISHNDYSYMENKDILLLIPSIITIGIGCRKDISFDNIERSVLNILDKENYHILSLNAIASIDKKANEKGILEFARKYNLPFNTYSAEELNSLEGDFTKSEFVKSVVEVDNVCERSAVIESNGNLIRRKDTCDGAGVTVALAMINPILSWD

SEQ ID NO: 6536 - protein, 243 aa, Methanobrevibacter ruminantium
MKCVSVVGIGPGNELYLSIAAKETLEDSDLIVGYKKYVELVEEYLPEKEYLYTGMTKEVDRCKMALEKASEGNCVSVVCSGDAGVYGMAGLVYELSVDYPDVEIDIVPGISAVLSGSAVLGAPIGHDFAVISLSDLLTPWELIEKRLALAGEGDFCICLYNPSSHKRKDYLKKACEILLKHKKEDTVCGYVRNIGREGEEYHILSLKELKDTEVDMFTTVFIGNANTKVIDNKMVTPRGYKGV

SEQ ID NO: 6537 - protein, 252 aa, Methanobrevibacter ruminantium
MHKIVLFGGTTEGRLLTEFLSQNKVPSIVCVATEYGEKVLDYEPPVIVQPKRLKPGPMRKLFQEEQTEFVFDATHPYATEISKHIKEACDEMGIEYIRVLRESIEIEGTTKVSSMDDLIDYLNQTEGLIFSSMGAKEAEALTALENFPERVYLRMLPSPEGIGHCLDLGYPMKNLCGMQGPFSKEFNMAQFKEIGADILVTKESGNVGGFLEKTDAAKECGMEVVVLSRLLNEEGISVEEAKDAIMSKCLRR

SEQ ID NO: 6538 - protein, 395 aa, Methanobrevibacter ruminantium
MKEINIIGMGMSEKTLTHEALELIHHADILIGAKRLINEFSKLNKPSFNAYLSDDILKIIEETDAEKIAILVSGDVGFYSAAEKLTDVLKDYNPNLITGISSVSYFFAKCSLPWKDANLISCHGIDTNIVSSVRRNRYTFALTGKNIPELQNELVKYGFGDLKVWVGENLGSEDEFINDCRIDDLCSREYGSLTVLIIDNPDFDSKSRTGIPDEEFIRGKVPMTKSEVRAVCASKLSIGPDDIAYDIGCGTGSVTIEMALSAYNGKVYAFDKKEEAISLLNENCIKFHIDNVEAICGLAPDCLKGLPTPDVAFIGGSSGNMDEIVNYLYQLNPNMRFVITAISIENAMAALDSLKDIGIEAEIVQVAVSKGKKIADLHMLIAQNPIFIISGDANE

SEQ ID NO: 6539 - protein, 453 aa, Methanobrevibacter ruminantium
MNRFLISGTSSNCGKTTITMALLAAFKNRGLDIASFKSGPDYIDPMFHRKVFNVKTHNLDPYFCTEEMLCEQFIRNKGNDLSIIEGAMGFYDGIGVEGRASAWEVAKSIKAPAVLILDAKGMSNSAAAIIKGFKEFKEDSMVEGVIFNNISPMLYPLLRDIVESIGIKAYGFLPRREEYSIGSRNLGLITADEIQDIKDKINGLSQLAEEYIDLDGLYELAKSAPELKTNDFIGEVLTDSQNEESADSSNKPRIAVSRDKAFCFMYEENIEILEDLGCEVVYFSPLEDKKLPDNISGLYLCGGYPELYKEELSNNKDLCSSLKEIISNGIPTIAECGGFMYLHDSIENVPMVGFIKGNCIKTDKLQRFGYIEIKALKDNLLCSENDSIRVHEFHYYDSENCGEDFMAKKASNGLEYLCCHGSDSLYAGFPHIYLPANPDFARSFVRNARNWKH

SEQ ID NO: 6540 - protein, 212 aa, Methanobrevibacter ruminantium
MKIELEQVEPAEIENRSMEIIESELPHEIDPKLAPIIKRAVHTAADFDYVDNLCFSEDVVDKALEAIKNGACIVTDTQMAKAGINKAELKKHGGDVFCFMSDDDVRDMAKKNHSTRARASMDKASQLDRPLIFAIGNAPTALIRLYELIQEGKLKPELIIGVPVGFVNVVQSKELIMQCDVPYIVARGRKGGSNVAAAISNALLYILRDQMK

SEQ ID NO: 6541 - protein, 262 aa, Methanobrevibacter ruminantium
MVDKIILVVSFGTSYNNNRALTIGAIEKDIDEAFPDYEMRRAFTSQMVINKLKRRDDLDIDNVQDALERAVNDGVKTVIVQPTHVMDGTEYHFKIKDTVDKYIDKFDNITIADPLLITDEDFEDLISSITKDDESSDETAIVYMGHGSPAESNMVYTKLQSMLGEKGFDHYYIGTVEAKPDYDDVLAMVKEGDYKKIILKPLMVVAGDHAQNDMAGDEDDSWKSMFQDEGYDVDCLIEGLAQSKDIRDVYIKHVQKAIDDLS

SEQ ID NO: 6542 - protein, 130 aa, Methanobrevibacter ruminantium
MERESYYFLLLLIGLVICAGVFYFQFNYATPTYLIFNATEVNEGGSFTGVLNDAYGFPVVNKTITYHKPGYEMGTLVDVQTDDTGEFVIENAQYLPDAGEDNYYGAFTFAGDGKYQGCSFDGNITVIPKK

SEQ ID NO: 6543 - protein, 222 aa, Methanobrevibacter ruminantium
MSNQDEENYMDDELLLNARKPKGELGEKLIENMNINHESLAQWSLNHLEIDKDDFILDIGCGGGVNVERFLKMTDNKVFGLDYSELSVEKSIELNRESIDDGRCEIIQGSVSDMPFEEGIFNIATAFETVYFWPDFVNDLKEVHRILKKDGIFFIANEALPNEYDKRQQRIIELLEMHIYSKEELEDSLEKAGFSDVKCFIKEAKDSFTGDDAYWICVIAKK

SEQ ID NO: 6544 - protein, 320 aa, Methanobrevibacter ruminantium
MDDYLIKSKSETNPEYGCNPYERPIEEHIAKGIINLDKPSGPTSHEVDSWVKRILGCNKTGHGGTLDPKVTGVLPIGIDNATRVSQLLLPAGKEYVCLMHLHREIPEDQVKGIFNEFTGKIYQTPPVKSAVKRELRVRNIYYSTIYEIEGQDVLFRIGCEAGTYVRTYCHDIGEALGCGAHMAELRRTRVGPFDERNNDLVNLHDLTDAYHFYLEDGDEEHIRKAIQPMEVASSHLPQIFIKDSAVEAICHGAKLGAGGICKLSKDIQKGNLVAIKSLKGELVAAGTSLLSSQEIMNADSGLVVDTNKVFMDTGIYPKGW

SEQ ID NO: 6545 - protein, 60 aa, Methanobrevibacter ruminantium
MDDKEKVIEAFKNSEEPLNAKKVSELSGVEKKEVDKIMKELKKDETIVSPKRCYWTLAEK

SEQ ID NO: 6546 - protein, 183 aa, Methanobrevibacter ruminantium
MVKNNNERFELDLSKNETPEFSNEEILSKMRRGFNNQYVCFEYPFLWQNMPIDEEDEFTDIMLFNKANNAIVKISTQPCLIDNIDDLKEEIEKDLKSNGCTIQQSAMEKMETQDIWDVFYTTKEGLEVEQFSILKDNNLYNLELYTKNNRDQATVKSFVDVIQTFTILKPTYKVDGDSYEKIE

SEQ ID NO: 6547 - protein, 47 aa, Methanobrevibacter ruminantium
MDGMDPEDYLIYNYYFEEEENNGLSKNESCCGVLMVLMILTILLTVA

SEQ ID NO: 6548 - protein, 167 aa, Methanobrevibacter ruminantium
MARREENTFDFLGLFTEEIGGKKNKSNGAIKFQKDKLFIEKRSRLNGKLKDSYEISYDELDSESIDRPAINRVEIKLKDKTISLKTLDHEMLDNFEDKLLDIVEGPKLAVEDSPVANAPYNAAEIKSDSKIGEIDIPDQIRKYHELYKEGIISEEEFENKKKELLDL

SEQ ID NO: 6549 - protein, 288 aa, Methanobrevibacter ruminantium
MEIKSIPQVIKEIQELVDKEDYESAYNIAKDNVDLNKEYTEGEYVFKNLLEELLFQVLIQKEIKKKIPMILDYSSLYSNYGEVLIQLDKIDDAKKSFELSRNYNPINIKANFGLGDLYKMENKLNEFYKLAIESFKIAYYPKDLAKSFRNLSYYFLKIAKEENADENLKIAIHLKKISKDYDDESELAKTELDEINGIISNFDKETVEALESTDLKECRNELKSKGLPYEAGIEIITICKNLGFQLDEAKKVVPALYYFNIAYDLTKDPDIKLVIDDLNEKVERRLDE

SEQ ID NO: 6550 - protein, 149 aa, Methanobrevibacter ruminantium
MEDDFKHLVRISRKDVDGNKTIEQALTQIKGVGLSLSRSICLTLGLNTTDKIGYISEDDVTKIEDLLENPQNYSIPDWMLNRRKDYATGDDLHLIESDLDMTLRDDLNRMKKTRSYKGRRHEVGLPVRGQRTKSTFRHSSTVGVSRSRR

SEQ ID NO: 6551 - protein, 178 aa, Methanobrevibacter ruminantium
MGHPRKARKKYDTPPHPWNAERIKTENKLMSKYGLKNKKEIWKADTLVRKYSREARYLLGFSQDQVQVETEELLGHLKRTGILDEAAHLENILDLTVEDILRRRLQTIVFQKGLARTAKEARMFVVHGHIALNGKKINSPSYVVKRGEEEAVGFYHSSPVAKQIEEYNKAASQAGENQ

SEQ ID NO: 6552 - protein, 130 aa, Methanobrevibacter ruminantium
MAKDEKWGIANIYSSFNNTILTVTDITGAETICQWSGGRVVRADRQQSSPFAAMEAANRAAEDAKEKGFVGLHIRVRAPGGNGPRSPGPGAQATIRALARAGIKIGKIEDITPIPHDGTGRPGGKRGRRV

SEQ ID NO: 6553 - protein, 282 aa, Methanobrevibacter ruminantium
MEIDVKKQDENSMVFIVRDAEVPFINAIRRIAMMRVPKLAIEDVFIVKNDSAMFDEVLAHRLGLTPLVSDLESIEGLVMREDCDCNHDENGNYVDKGEYCPRCSVSFSLNETGPKVVYSRDLKSCGDSRIKPVYDTIPLLKLKEDQDVELEAVAKLGIGKEHAKWVPTTVCAYKQYPEITFNEGEDVVYQVADACPRNVLDANRDDGVIEVIDIENCSLCKTCVRTAKAAGSKFINVGYRENDFIFKIETDGSMPPKEVLLKACDVLDAKTDEFITFSEGGS

SEQ ID NO: 6554 - protein, 121 aa, Methanobrevibacter ruminantium
MAREIKKTNPNLIALIYNLRKQSYEEGVAIWKDVAIKLEKPARNQAEVSLSHINKNTVEGETVVVPGKVLSDGKLDHKVTIAALGFTKNAEAKIEKFGCEALSIAELAEANPKGSNVKIML

SEQ ID NO: 6555 - protein, 142 aa, Methanobrevibacter ruminantium
MMIINGEGHILGRLASVVSKQLLEGEEIVVLNAEKIMLTGNKDWAYAKYKQRVDRASISNPRDLGPKYPRRPEDIFRRTVRGMLPMKKAKGRNAFKGFKAFVGVPEEYADAELLTMPEAEYNDIKKGMELGEISKLLGAKFD

SEQ ID NO: 6556 - protein, 132 aa, Methanobrevibacter ruminantium
MKVVHASGKRKTAIARGTIREGTGKVRINKVPLELYSPELARLKLTEPLELAGEVADNVDISIRVNGGGVMGQAEAARMVIAKGLVQWTQDMDLKEVYTQYDRTMLVGDPRRSEPKKYGGPGARARKQKSYR

SEQ ID NO: 6557 - protein, 56 aa, Methanobrevibacter ruminantium
MIPIRCISCGKPVSAYFDEYNSRLADGEKSKDILDDMGITRYCCRRMLISHVETWE

SEQ ID NO: 6558 - protein, 72 aa, Methanobrevibacter ruminantium
MAAKKSTAKKLTRFEKARVLGARAIQLSMGAKPMEHKEIEKFIKNSKSLDPIDIATLELELGILPLDVRPKE

SEQ ID NO: 6559 - protein, 415 aa, Methanobrevibacter ruminantium
MDSVIEDVRVRKILDSRGNPTVEVDIITWNGFGRAAAPSGASTGSREVVSFPEGGVDQVISEVEDLISSELIGMAAEDIEDIDEVLREIDGTDNMSAIGGNTSVAVSMAAAKAAAMSFGMPLYSFLGGNFVSEMPYPLGNMMNGGAHAGPNAPDIQEFLVVPIGAKDVEEAVFANVAVHKKLKELLSKKDPDFTGGKGDEGGWIPNITNTQALEIQAQACEETRDELGILIRPGLDMASSEFWDSEKEKYVYSQDNIERDVGEQVEYVKDLIETYNLFYVEDPFDENDFEGFRELTSKVGNKCRICGDDLFVTNSRLLKKGIDEKAANAIIIKPNQIGSLTETYATVKLAKENNVMPVVSHRSGETCDETIAHLAVAFGAPMIKTGAIGGERIAKLNELIRIEAELSNPKMARLF

SEQ ID NO: 6560 - protein, 63 aa, Methanobrevibacter ruminantium
MSTVIIDASKCENADCGECVDMCPMEIFSLDGDKIVTDHEDECTLCEVCVDMCPNDCITIKDE

SEQ ID NO: 6561 - protein, 198 aa, Methanobrevibacter ruminantium
MSDLLIPLDNYLAAGLHIGTQQKTHDMEKYIFRVRSDGLYVLDVRKTDERLRAVAKFLAKYDPDDILVVATRQYGQAPVKKFGEITGCKTIPGRFIPGTLTNPGYAKFIEPKVIVVTDPRSDSQAILESKQNGIPVVGLCDTENLLANVDICVPSNNKGRKAIALIYWLLARQILRERGILGEDEDLDLEPSDFELKF

SEQ ID NO: 6562 - protein, 298 aa, Methanobrevibacter ruminantium
MDNIKDKKINDKIQKQLANESVNELLSITGIKSNVIQPLTVEYVDVADTRIADYVGLEENDSIRLLEFHTGAPNENLDFKMFDYSSMIYKKYRKPVNAVAICTERINEPEGKLEWGDRNKYYYDIVTYKDIDGELELNIIRNKNKFNQKLSSLEIFTLKMILYTSFDKKPHEIMLDACKLTNEANLNQYLLDEIKKFQELTCRKIIDEQYHRGIADVIAMKNTLFYEDLKKSEERGIRIGEKRGISIGEDKKEFHMRIHIIKNLLGKISNSDLAKSLDISEEELEEFIKENNLTPSKD

SEQ ID NO: 6563 - protein, 81 aa, Methanobrevibacter ruminantium
MINWAAEMKTMKNTLFYEDFKKSEERSILIGEDKKEFHLRIHIIKNLLGKISNSDLAKSLNFSEEELEEFIKENNLTHSSI

SEQ ID NO: 6564 - protein, 282 aa, Methanobrevibacter ruminantium
MIREAVVAGTFYENNVKYLRESIEDCFTHRLGPGEIPKLSRVNKEKEVNAIMVPHAGYVYSGPTAAHAYSKLVQDGYPETFVIIAPNHTGFGEHVSIFNEGSWIVPNGVADVDDELANAIINQSNYAKADFLAHRNEHSIEVQIPLLKYFDSNFKIVPICMMDQSPQASIDLANSIFEAANDLNRKITLIDSTDLSHFKSQEKTIEHDNLVFNEVINGNTEGLYQVVKKEQITMCGYGPTMVSMEYCKKLNQKNFELLQHSTSGDITLDYASVVGYGSGVWF

SEQ ID NO: 6565 - protein, 327 aa, Methanobrevibacter ruminantium
MRKMSVASAPGKTILFGEHSVVYDEPAIAGAVNKRASVKIQESLNNYSTLKSYDLGFEVILNTRRGTYKLVKGKPGIIRYILNAMGKFHDHSNIDMTLGLNLPIGSGLGSSAAVTVATIAALHDYHGVPITKEKLAEEAHGVEQDVQGIASPLDTLVSTNGGLVYLSREKRIVRFDKPLDAPFVIGFTNKYGNTGKMVKHVRHLKDNYPELINPVISTMGKIANEARIAILKNDIDRIADLMNLNQGLLDGLGVNTYELSRMIYTARENGALASKITGSGGGGSIISLCKNSTVDNVANAINKEDSTIKVKFSGEGVLVNRRSPPFN

SEQ ID NO: 6566 - protein, 271 aa, Methanobrevibacter ruminantium
MIILKIGGSILTEKDSAEPKVDYANLNRIAEEIRQSLYSDEMSNDLIDGLVIVHGAGSFGHPPAKKYRIGEPFDMEDYLSKKIGFSEVQNEVKKLNSIICQSLIEHGIPAVAIPPSAFITSHNKRIYDCNLELIKTYIGEGFVPVLFGDVVLDDEVKIAVISGDQILQYIAKFLKSDRIVLGTDVDGVYTKNPKTHDDAVHIDKVSSIEDIKFLESTTNVDVTGGMVGKVKELLDLAEYGISSEIIDANEKGAISKALQGMEVRGTKISKE

SEQ ID NO: 6567 - protein, 350 aa, Methanobrevibacter ruminantium
MISDRKLEHLLICKNYDVSYNDKTTGFEDIELIHRALPEINNDDIDLSTEVFGKKLDSPLFITAITGGHKAAKDINKELAIIAESRNIGLGLGSQRAAIVNPELRDTYDVVRENAPDALILGNIGAPQSDLAIDAVEILDSDILAIHLNPLQESIQPEGDVDARGYVDSIKEICKTVDVPVMAKETGTGIRAEDAIELEKAGVSFIDVEGAGGTSWAAVETYRAEDRYLGELFWDWGIPTAVSTVEVVNSVEIPVVSSGGISFRTRCKLRAIALGADAVGMALPALKGAYEGQEALNQMVNRFNESLRIAMFLLGASNLEELKRSDLIIKGETKQWLEARGFDTKHYARR

SEQ ID NO: 6568 - protein, 449 aa, Methanobrevibacter ruminantium
MTVEVIAIGGYEEVGKNMTAVKVGEDVIIFDMGIHLDRISIHEDTDIDRMHSLDLIERGVIPDDTLMKDVDGKVKGIVFSHGHLDHIGAVAKLAHRYDAPIIGTPYTTALIEKQIKGERKFKVNNPIRPLNPGSKIKLSKDITLEFVQSTHSIPQAVFPVLHTSEGIIVYALDFKFDNHQKVSPPPDYNRLRELGRKGVLALIVETTNAINYTETRTYSEKVARIILEDLMKRAFKGQKEGMIVTTFSSHIERIQTIADIAKDSNREILFLGRSMERFCGIAQNLGILKLPQNAYVYGSPKAVNKALMKAEDDRDQYLLVTTGHQGEPDALLPRIASARTPFNVKKGDNVIFSAPIIPNPTNAANRHILESKLKANGARIYANAHVSGHAGREDHRDFLRMLRPKHIIPAHGELEMLVAYGELAEEEGYRIGNNVHILRNAQAQVFNGD

SEQ ID NO: 6569 - protein, 331 aa, Methanobrevibacter ruminantium
MSDVTDVLKEYSADVIKTIEENLAPVQPQNLQDACIYLTKAGGKMLRPALTLISCEAVGGNKEDALKTAAAIELIHTFSLIHDDIMDDDDMRRGMPSVHKVWDEPLAILAGDTLFSKAFEMIISSKEENAHPEHVANALATVADACVKICEGQASDMSFEGDFDVKEAEYSEMIYKKTGALIAAATKAGAIMGGADEKEVTALYEYGRMIGIAFQIQDDYLDVISDEKDLGKPVGSDIAKGKMTLMVVKALAESDGEDHERLLEILKDNDCSQDMVNEAIDLFNKYGSIDYAYNLALENVNGAKEAIAFLPDSDAKSMLIALADFVIARSS

SEQ ID NO: 6570 - protein, 290 aa, Methanobrevibacter ruminantium
MGFKDKVLSSSNQFNYYKDNYEKLLNENKQLKQKQNQLIEENEQLIKEFELNKQIIINKENLSTESNYCPYCGRISNFEPYGVVKREKAMCPYCKSLERHRLIYLFFERNYSSIFKNKDIKLLHFAPERIFYNYFTQFDHVDYYPVDIDPETYAKRGLKLKMKVNMEEVPYGDEEFDFIYNSHVLEHVPNDFKAMGELYRVLKQDGVCITVVPLSGNEETLEKEEYNTPELREKHYGNKDHLRFYGLDVKQRLESVGFKVKVSKLEDLNLTEKEIELFNVKESLIFVCTK

SEQ ID NO: 6571 - protein, 219 aa, Methanobrevibacter ruminantium
MDLPSGDNYENTTVNEAIRQINDTNRDLTVLFYNSEDNSTVARVEFEFTINDFKATATEQTVANRTVWYNEENGTYMAFLGNSVTHDNIIIITNDVEILEHLISSVKFIFLNEDGTVNSTSDMVNNQSINVTGGTASNGTDASASTATSNVSSSNSQSTGNDGYYWSGQDQDYIKEYTDSNGIQHIDRRNGPNEAYDPNTQRHYTDGVEDTAAYNQDFN

SEQ ID NO: 6572 - protein, 190 aa, Methanobrevibacter ruminantium
MIEKVRFDQIADIFTGVRVKRYQKGKGTTVERPILKKTYSENSSKLDLEYEEVSEEIHERFYSQENDIVILLAGSKVSKIEEAGIIIPMYYAVVRVKEGYDVDFIYHLLKSDIFPRELHKIEEGTTLKIIKTTHLKSIYLPVPDLETQINYGKLFNLMDKRIKLNMELAELEKQIEKSIINEMLLEEKTF

SEQ ID NO: 6573 - protein, 634 aa, Methanobrevibacter ruminantium
MSSRLGRQLWDKYEELRTNSMVGFLTDEDFQKYFLGFITYKYLSENLELYLDKELEKDDLKFEEAYNFENYGKVLAKKAIYNLGYFITPNHLFRNVIASYNQGADISRELKWAFAEINSSCKKTESQEDFENLFESVNLQATPLGKKQEDRNRVIYNILNALDSVDFGLDEFNSSLSLINHYSEPARELGVNLDALEKELLSDPNKNIFLDDSPLNESSSIPLNEAPFEEYASMELFLDDIAPVEEFDSMELSNKENIVTGLENPNHPNSLVNEGWNDRSYDSYRIQKQYSIGDAFEYLLDKFSLNASKSADFYTPNDVSVLVSKLVATNKRAIDSVYDPCCGSSSMLLELNKHVSLNLICGQEVNAYYYNISRQNMILHNIHFKDFDIKQGDSLDSPHHIGYDKFDVVVSQIPFNVSWTAKKSFLNDQRFKEYNALAPRVKAEYAFIQHMLYHLDDDGIMVVIAPHGVLFRSASEESIRKIIVSKMNYLDAVIGLPSNMFYSTNSPACVLIFKKNRRYDDDVLFIDASKNFNKIKLRNNLRKEDINKIVGTYVSRAEVDKYSRRVSLREIDENNCNLNIPRYVDTYEEEEINIQEIYKRREEASRELKEVTYEIDELCKELGIENPLINNIFE

SEQ ID NO: 6574 - protein, 306 aa, Methanobrevibacter ruminantium
MSKTYIFGHKSPDTDSITSSLVMCDLENKLGNADVVSCRLGNLNKETEFVLDYFDIEAPQLIESIEDDAEVILVDHNSPSESVDNIENAKILKLVDHHKIAFETSYPLFIRTEPVGCTETILFKLYKENGLTPDKTIASLMLSAIISDTLLLKSPTTTEDDKQAVKELAEIAQIDYEEYGLEMLKAGTDLSSFSIEEILSLDAKQIDFKDVRSIVNQVNTADIDDVMTMKDDLEAGMNKIIEDENLDLFMLLITDIVNSNSQVIALGKDVCLVEKAYGVKLEDNTVLLEGVVSRKKQVVPIMTENA

SEQ ID NO: 6575 - protein, 131 aa, Methanobrevibacter ruminantium
MEINDFGHDLDESAQFLVQKLLILHPWDEEWDLSVTANLVPFYKEKIDIQISKQGKCDEEFFDKLIRFSSILDTNQVRLLFMEQLVGMPLILDGKYLNNDERIDLLIESLNGRLKRVDNGLYLFFNHEEEF

SEQ ID NO: 6576 - protein, 389 aa, Methanobrevibacter ruminantium
MIYRKLGKTDLEVSNIGFGCMRLPHKEHFYQIDEAEASKMFDYAIDHGINYFDLAYSFHSKNKNLGGNAEPFVGKYLAERGNREDMVIQTKLPGWLVNKREDMDKFLDLQLERLQTDYIDVYMLHSLKIDFWNKLYGMDVLEFLDSILEDGRVKYVGFSFHDDLDVFFSIMDSYDKWDVILTQVNYLDEDYKSGLGGLEFVGMAGLGNVIMEPLRGGSLITNIPDEVQALWDTADKKRTPVEWALEYLWDKPLVTSVFSGMSNMEQVKENIAIAENCQPDCMSEHDRQILKDVAQVYKSREEIPCTGCRYCMPCHNRVDIPHCFKQYNIAKSLNYIDKTAAPYFWLVNKDERADSCTFCGECNIQCPQGIDIPAEMEKVFDFFHEESQY

SEQ ID NO: 6577 - protein, 275 aa, Methanobrevibacter ruminantium
MNHDELINLDAIDWEEVWQKSLKKSFKKEKNWDDIAKDFGQWLENDDYPDVLLEEMRIDEEDTILDIGCAEGTISRKLAKKAKSLTGIDKSKLMLEELNKKAEKERIDNITTIQMDINELNYEEIGDYDIILASRCLNGIYNIKNTLTTLNEIANKYVYITVFGSKSHKYKKEKCEIAGKPFKAGTDYMVLVLLLKSLGIEANVVQLECKNLKEYRDFDEAINRSVWRFGELEEDREIALRQYFKETLVKNERGNWVNPKDKTDLVLIWWKKEEE

SEQ ID NO: 6578 - protein, 274 aa, Methanobrevibacter ruminantium
MTKKIIIEDENEIDWDQLWTAKMDKKGDRGKDWSKAAEKYSERASKDNYTEQLISKMIISKEDTVLDVGCGEGSVTIPLSKEVKSITAIDATDKMLEILDEKIKSEGIENIKTIKEDINDVNLEKYGKFDIVLASRVVNGIKSPKKVFSNFNEMANKYVFITLFGPNNWKLEKDFHEYLSKEYNGAPSYTILLNLLAEMGIYANIINLDVGPVRTYKTIEEAIDNGKWNLAKFSEEEQEKLPKFLNEVLIRDNETGLLSNSEDKPDWVLLWWKK

SEQ ID NO: 6579 - protein, 271 aa, Methanobrevibacter ruminantium
MSFQIDDPEDIDWAYFWAKKLESKKDRAKDWNKAAPNFGKSAKKDDYHTKIIERINVSKEDTILDLGCGDGSITIPLAKKAKSVTGVDSAYKMLEILNENAKKEGIENIRTLEEDLSNIRVNDVGNHDIVVASRSLNGIINIRETISNINEIADKYVYITLFGPNNWKIEKEFFESIDKEYVEFPSHRYFFNILVDMGIYPNVENLNIGHKREYENIEEALESGKWRLELLDDEEKAQLYKYLEDILEEDDNGKLSNPNDKADWVLYWWKK

SEQ ID NO: 6580 - protein, 164 aa, Methanobrevibacter ruminantium
MDGRLDIDSFEKAINGLNKNLYDVGALFQANMPLLASEASQAAKENCVNKMADRVDERLDSFRENYGYYNDFYEKLKENVKNDTIENPEEYDVFLEHASNTFPKYIDELGQTIDSLSGIPIRTEKFDSTMRELGSIIENFRFDFKRTLTVADVYKVQKEMKSQE

SEQ ID NO: 6581 - protein, 87 aa, Methanobrevibacter ruminantium
MKAVSYIKRSNNRYVLVMNMNGKFKMPSEIASEMDLRINQISAVLSDLKKEDIVTCINEEEKVGRLYKLTDKGLEAYKVIKTNEEIQ

SEQ ID NO: 6582 - protein, 556 aa, Methanobrevibacter ruminantium
MDELEEIVFKHALLNAAKHKGSANPGAVMGSIMSNEPELRPRAKEIGPISGKIVAQVNAMSPEEQKTKMEELGVEVEEKKKKKEEGLPKLPGSNKNVVMRFAPNPSGPLHIGHARAAVPNGEYVKKCGGKFILRIEDTDPKRIYEPAYQLIQDDLKWLGIEPDEVYYQSDRFEIYYQYAEELIKRGAAYMCTCDGGEFKKLKDNCQPCPCRDNSVEENMELWKRFPEMEAGEAVLRIKTDINHKNPAIRDWVAMRIVEEEHPRLGTKYRVYPMMNFSVSVDDHLLGMTHVLRGKDHLANSEKQKYLYNHMGWEIPEFIHYGRLKMEDIALSTSKAMAGIEEGTYSGWDDPRLGTLRAIARRGIQPETITQLMVEIGIKMSDSAISWKKIYGLNRNLIEEKVNRYFFVPGPVKIDIADVPEDILGWEVIRPLHPDFEERGNRTLIFDKELYIPKADCKDGIIRLMDAVNVEISGEDVKFHSESFEDAREVKARIIQWVPLDAIKAKIVMDDASIVEGLCEKDCGDLKVGDIVQLERFGFARLDEIKDDELIFYFAHK

SEQ ID NO: 6583 - protein, 148 aa, Methanobrevibacter ruminantium
MDKKLAVIFIGIQGSGKTSFYKRYFPDFAHVNLDTFKKRSKERKFFNMCIEEGKSFVVDNTNPTKFDRQRYIPTARENGYEIWGYFFNSPLEESMERNNQREGLARIPRVGVLSTYKKLEVPEYDEGFDKLFYVKIKDGQFVVGELEE

SEQ ID NO: 6584 - protein, 762 aa, Methanobrevibacter ruminantium
MKEVTAILLVIIALIGIISIIIVKLYYREKEKDHDKERLEEFLNSSDYNSSIESHEKISSRQKAEGSKKPQKVQRRRRVRKVPKESQNRNENLSEAQIYANTLQNASNNDLFVDYDGDNRGAQRTRKVRRVAKAETAETTQANGTAALLRQRAEAAKAREQAPRTKVRKVRKVKSQEDTVQKVQRTPDRVKEQMNKEEKVKPIQEPITKEHKETINSVRQGESEVKPRQVPMTKEQKEFISSETAKKLIVEDDDGAVKVVKSIKPAEDIEEIKESALIEKAETTEEAKVKVTEETPKVEEKAETAEEEAPKVEEEVQTEEAPKVEAEPVQETTEEVKTEEAPKVEAEPVQETTEEVKAEETKVAEKPAEEVAEKVEAPKAGKPAEEVAEKVEAPKAEEIKEEVTKPAEEPKAEEVKAETTGEIKSDAPKVEAEPTEEPTEEIEVAEPTEEPTEEPTEEIEVAEPTEEPTEEIEVEAVDDYIEALETEGVYQDDLHILLGEEKIEDEGPENEFVTINSDRQSSSGGNDIFRDAINSIRKFRGANTQQHKVEEIKEEVVPDDYIHNFGNGIEEIGDTITITPIREDEIDDLAYNQPNEDVDEIYKEVNEEEYNKTIDSELDEAYEDVTDETSEEEANTYTVEDYKQIEKEEEEKKAREENTQKILDLKGIESKKPRSSKKESVSTEQPEDPAQKQLVFTEQRSNVEEVYINGKLIELKLGQTVMFNHNNETYSSQILKLKPGFVGVKYRGKKVWIKATDVKRVL

SEQ ID NO: 6585 - protein, 410 aa, Methanobrevibacter ruminantium
MVKINENYLLLQNSYLFVEVNRRAEKYMEENPDKDVIKMGIGDVTKPLTPTVIKAFKDAVDEMADGETFMGYGPEQGYDFLAEAIIKNDFNRWGVDLDLDEVFISDGAKCDTGNIQEIFDLDNVIAVTDPVYPVYVDTNVMAGRSGLIKDDGMYANIVYLPCTEENDFVPALPEEDVDLIYLCFPNNPTGTTLTKDQLAKFVEYAKENDALILFDAAYEVFITEDDVPHTIYEIEGAKEVAIEFRSFSKTAGFTGTRCAYTVVPKEIKIKTSTGDEQSVNALWNRRQTTKFNGVSYPVQKAAEAVYSEEGQKEIMENIEYYLENARIIRESLSDIGLNVYGGVNSPYIWVKTPNDMESWDFFDLLLEDANIVGTPGSGFGPSGEGYLRLTAFNTLENTKEAMNRISKLSF

SEQ ID NO: 6586 - protein, 226 aa, Methanobrevibacter ruminantium
MEADFSLVNENDDLQDLFSKYGALALEKQENLSKLVGDSEPELDIENGIVKFGDKEFPIQLLGFLDPDEDTWSWAWDNEEIGFPEELIEEAKEVKEFGEDQNIVQFKQSMFAASFEEAHILSMTVSSIFGDDAYCGVNYGNFVFFVTIKSDEIPSSEGPEEFSNIFNEFHRRFEVNHLKALESYAMLKGYEYKYRDDFALVKIGDNRVVVGLTERKNVQSIKFILA

SEQ ID NO: 6587 - protein, 208 aa, Methanobrevibacter ruminantium
MDSELIEEISFEIQLLLKMGFYNDEEILEIIDDEFIEEDIPKEKLLEIFSNVKENFDCPKSDSEDFLNLKEAFLNLSKNHNILTIHNAGYDIEEGIQDSFELFTHLRNNKYEVEGFCFYSFEDIEIAIEENSLLIAFGDFEFDEDKGLKIAKTVKDELVSKGFNINWDESIDERIEIVDFNWQKAYEDRDYSMDGALSDYIELNNLED

SEQ ID NO: 6588 - protein, 222 aa, Methanobrevibacter ruminantium
MNARSFEIIEEAISNGVWTWLELDCYSNSLYLEFERLQLLSKSIVNPFKPVQESTYNDYRGELAIRFGTNIYLAILYDDEDSFDFLDLEEDILNSFLNSDAKLSDNDSYFYRQFKKEIRGFKFQDEDYSSNLTKKYKKEIVLAQLPNKKDSYDFLLSFELDNFAIIVKGDIISCFNDFESLSDGDIKRASNDWILYYLDYWIKKGTEEEYDEDFLCENISFD

SEQ ID NO: 6589 - protein, 180 aa, Methanobrevibacter ruminantium
MNQLRPGYNFLATHELFFDEIPHQRAIHLANYEFFWNILDELGPFGTEESYLAFCELCDWLIDNPNTPIIECFRWILSSWDIELEDFDDKVIENENILKIIYDLDFYEDLMMLDFTIISTGFGQLILQGKIDADVKNIIQLSLLRQMNSHVLDEYLGSNMQYKYERYLYLQKLLDILEEA

SEQ ID NO: 6590 - protein, 339 aa, Methanobrevibacter ruminantium
MTCSILVGGAWGDEGKGKCITYLCDTDKPDIVARAGVGPNAGHSVEFNGEKYGLRLVPSGFVQTEAQLLIGAGVLVDPEVLFHEFDYLSKYNVRERTLVDPRCSIIEPEHKERDQASEHLAKKIGSTGSGCGPANSDRVLRTAKMAKEIPELADYLTDVSLAVNDALNDGQDVFIEGSQGFALSLYYGTYPFVTSKDTTASSFAADVGVGPTKVDEVINVFKSYISRVGEGPFPTEMSQEEAESKGLEEYGVVTGRRRRIGYFDMELAKESCRINGATQIALTCVDKLYDCARVRDYAELSQETKDFISEIEQETGVPVTIISTGPDLQDTIDLRKELL

SEQ ID NO: 6591 - protein, 394 aa, Methanobrevibacter ruminantium
MRCVGTVVRGIRTPIIKENDDLATIVVDSLMAAKESEGFEFRDKDIVAITEAVVAISEGNYVTVDDVAEDVAKKFPSKEIGVTNPILSRNRFSIILKGIARGMDKITLLSSFPADEVGNGILDERALDESEFNLGSVITEEDYEKNFSSWIHPFTGINMVDFYRELIESEDCEVEFVFSNDVKTILDYTNDVLTCDIHTRKKTTKMLKEKGANVYGLHEILVEPIGDSGCNPEYGLLGSNKATEERLKLFPKTGDKLVNEVQKRLIELTGKQIEVMVYGDGAFKDPVGKIWELADPVVSPAHTAGLVGYPNEIKLKYVSDNQFADLHGDELKEAIKEEIRQKAENLTGQMITEGTTPRVLTDLIGSLCDLTSGSGDKGTPVIFIQGYFDNLAND

SEQ ID NO: 6592 - protein, 127 aa, Methanobrevibacter ruminantium
MKDIINPNVEIPDEQVAMAFFRSVRWVNGVYCPKCKSYNVNNRGNQGRTRRYVCKDCGSNFNDFSGTIFHKSKIPLNVMLYILFNLDEKTTTQLSEELGYSRQCISRISKLFRDKLLSNPEFFDIEE

SEQ ID NO: 6593 - protein, 247 aa, Methanobrevibacter ruminantium
MEIKKKFLPFILPAILLIIWYLITDGLHLIPYYILPSPLNVFNAAWTLITNGKLFMHTSSTLIKVFSGIILASVVAIPLGIILGWYETLDRLSSLIISILRPIPPISWIPFSILWFGIGLSSAVFVIFIGCVFSVLVYTIDGVKRTDNVLIEAAQTLGANNWDILLKIVLPSTLPYIVSGLKVGVSIALMCTVSAEMIASSRGLGYMILTASQLFQPGTVVVGMIVIGIIGILFDYGFRKAQERIFW

SEQ ID NO: 6594 - protein, 253 aa, Methanobrevibacter ruminantium
MFILAIDIKNVSKSFVTKDKDFMALKNINLHVDDGELICLLGPSGCGKTTLLRMVGGLEKPDEGEIYDRGELVTGPSKDRGFIFQQYSLFPWLNVLDNVMFGLNLNKDTSKEENLAAAERYLERVGLAEFKYSYPHELSGGMKQRVAIIRSLLNHTPVLLMDEPFSAVDMLNRHSLQEQLIGVWKRFNTTILFVTHDVDEAVYLADKIVIMDKNPGRIQDVVEVPLERPRQRESREFLDFQDEIEKLLGVWEP

SEQ ID NO: 6595 - protein, 266 aa, Methanobrevibacter ruminantium
MIGLSIAGFDPSGGAGISTDMKTMAAHGVHPCSVITALTAQNPKKVFSVQAIETSYIRQQIDSIFDEYPIKYSKTGLLYSKEIIQLVSKKVEELNLRIVVDPVMVASSGGQLAKKEMANSLKKYLLKNALLVTPNVKEAEELSGISIKSIEDAKEAAYKIGECCNVMITGGHLDGNNVIYNKQKDELSILKQNLIKTDNLHGTGCSLSAAICANLIILNEKDKDSKDENNLEIAIERSTKFIYEAVKKGRYGTLNPNFNSNLDFLK

SEQ ID NO: 6596 - protein, 234 aa, Methanobrevibacter ruminantium
MDKIYAIIPVNQFANAKTRLSPFLTPEERRDLLKAMLKDITDTLKPIVDKVVIISRDEEVLAYAEELELTTIVEEEYKKSKAVNSSDDNPLNKALKQAMKWSRKKTRKVIILPSDIPLIGKTNVKLLIDQAKNFDFIIVPSKGGGTNTLIIKPLAIDMKFEGFSFNKHIEEAKRKKLVPIVHDSFYMALDVNTTEDLGEIMLHGNGTETKKYLESLGIKVESSHDHERLKVTRD

SEQ ID NO: 6597 - protein, 468 aa, Methanobrevibacter ruminantium
MENFSEWFHEILEKAEITDSRYPIKGMSVWLPYGFQIRRACLNIYRDLLDSEHDEVLFPLLIPEEELAKEGIHVKGFEDEVYWVTHGGQKELNEKLAIRPTSETAMYPMFSLWVRSHIDLPIKQYQVVNTFRYETKHTRPLIRVREITTFAEAHTVHSSPEEAAEQVETGIEIYKELFDEMGIAYLISKRPVWDKFPGAEYTMAFDTIMPDGKTLQIGTVHNLGQTFAKTFEITFENKEGNHEYAYQTCYGISDRVIAAAIAAHGDEKGLILPPRIAPKQITIIPIIFKDGGEEVMAKCLEIKKSLESKGIRVQMDTRDIRPGKKFFDWELKGTPLRFELGPRDLKNNVAILGRRDTGEKIEISLEDDLPSKVEDLLMEIEENLKAKSWKAQEDKLITLESLDNVGEIVDEEKVVKFYWCGEEECGKEIEEETEVDILGINEENIKTDKICPHCGKPAKHVALMAKTY

SEQ ID NO: 6598 - protein, 347 aa, Methanobrevibacter ruminantium
MDSKKIQMPREVHIGPNVLDEVGEICKDLRLFDEALVVSGFHTFDVAGQQTVDALESSDFGVDVVKVKDASVESVEKVREKIANASVVLGVGGGKIIDVAKLASTYEHSYFISVPTTASHDGIASPMASIKNDKGSISKNANSPMAVVADTGIINTSPFRLIASGCADIVSNYTAIKDWRLAYRLRNEKFSESAAALSEMTAKLIINSSDSIKEGLEESARIVVKSLFSSGMAISIAGSSRPASGSEHLFSHALDRIAKKPALHGEQCGVGTIMMMHLHGGDWRAIQSILKTIGAPTNASELGLDDDEIIDALTIAHTLRPERYTILGDNGLTRDAAIKLARKTEVI

SEQ ID NO: 6599 - protein, 146 aa, Methanobrevibacter ruminantium
MITLIGKKLAKEGESFIFYEPAEECSTCRFKASCIDSLEEGHKYTITEVRDVEQKCPIHEDEKVQVVVVEKGETTILTDSKGVFEGSSFEFNRQGCSNKDCDFRDMCFPEEIGKGEKCVYIKDLGKFNDCPRGNSLIKCVVKIYDK

SEQ ID NO: 6600 - protein, 222 aa, Methanobrevibacter ruminantium
MSQMKKDCGYAAAELVKDGQVLGLGTGSTTLYFIEKVGMRVRDEGIEVMGIPTSFQSSLLARKWNIPITSLDEHEIDLAVDGADEIDPDFNLIKGGGAAHTIEKIVDYSAKELVIIADDSKLVNVLGAFPLPIEIIPVSLNPVTKALEDMGGEVNIRMGQAKDGPVITDNGNFILDVSFGEIDNPISMEKELNTLPGVVENGLFTEMVDKVIIGSKDGVKYL

SEQ ID NO: 6601 - protein, 444 aa, Methanobrevibacter ruminantium
MKVVIVGGGAGGISTASNLRKLDEEVEIVVLTRDNQVSYSPCAIPYVLSDRIHSFDDIVMRTVDDYKAKNIDVMLETEVTGVDSAKKQITYSKNGVVQTMNYDKLVLATGGSPFVPPMKGVDLDGVFKIRTLDDGKQVKEWAENCKSALVTGAGLIGIEIAYAFKKMGLKVTLCEMLPQIVPRSLDPDMAKILTDYLIEEGIDVVLGQPITELKGEDGKVKKAVFEDGTEADADMVILATGVRAELNLAKMAGCDCGRWAILVNDRMATTVPDVYAVGDCVESYSAILRSNTVSQLGTTAVRQAKTLAQTLAGKRSRFNPVLNSMVSKVGKLEFGAVGLTRSFAQQNSIKAVVGKVEALTRARYYPNAKPMNVKVICDADGTIIGCQIIAEERVAERIDTMTLAITQELTCFELSNMEFAYAPPVSMVTDPLVIAVEEVSKKFN

SEQ ID NO: 6602 - protein, 691 aa, Methanobrevibacter ruminantium
MTKIFISCALPYANGPCHLGHLRSTYIPADIYARYNRMAGNDVLMVCATDEHGTPIAVKADAEGKKPIEVAKRYHDMIARDIESCDISLDNFARTSDELHYKISQDFFLYLYEKGLIYEEAIQQLYCENCEKFLPDRYVEGICPVCGAEARGDHCESCGRALEPTELLEPHCLTCGNTPVIRDSTQYFFKLSHFQNQLEEYITTNEYLPPNVRNYAQNWLKEGLEDWIMTRDMKWGIPVPLEGAKGKVIYVWGEAFIGYISSAAAWSRRTGIPWEDYWDGHVVHFIGKDIIYHHSLFWPAMLMGHDCKLPDDIFAGEFLSLEGRKMSTSKNWVVWVSDFVKDFESDLLRFYLTISAPLNKDTDFSWDDFGRRVNDELADIIGNFLHRTFTFTHKFFDGKVPEYANPSEEDLEFEAEIKELPAKVGELISSMKFREGLVEILKTAKSANKYFNDQEPWKAVKENPQKASNCLYLSNQFCKSLAILLKPYIPNKADAICDIINISKENVWDDASIFLENGHEINKAKPLFKKIEDKVIEAQKEKLYANLEDSEETKDDKDNKKDKKDKSNKNKSNKDKKDKSKSNDGEKMDLISIDEFAKVEIRIGKIVEIEKIEKSNKLLKTQIDIGDKTIQVIAGLGKRYAPEDLLGKKVPVVTNLKPAKLMGELSEGMIMATESAAILTPDDCEIGELLM

SEQ ID NO: 6603 - protein, 525 aa, Methanobrevibacter ruminantium
MDESLMITESEKFLNQIEREKLDLTNLKSDFSDLESYLEVYELLKSNFDKLQDMKESMDERGYTAPFRSLNRYGSRVSEDVDYEELGELNRHNTIFRNNASAKKNSFDRVKYAIAAHRIALGNLEEYAKIRCKDCQKSYKVSTFLENSKTCKCGSTDFELKVNHSGIHRLEIIPYLPLSGNYMVLLSSLSGWGRDSFRRILNILQQKRKGVVKTVTPIIRIKENGRTITKRVNLDSEFADCYEEELRRIYGKGVRIERLEFHSTKPTIVNDKYTRTNLALAYVKHAEDIVSRHEEEIFEENIKDLNNLKTYDELIYSVNLEKPEYMDEDDLDSWREQKIQDNLLELGLMDKYGHLDKQLKKDLKERERIKSKIFADIAPTLILWDISKYYLCTSYDRRKRYGSPFPFIRNDLDRQQRKVFANPHANVVGLLREKEKKHMIAIDEMDLLLYKKFKLEKRIKNTNFKLNYAALGPAIVFANSDYNIKEVSRAYKVGEKSVKREIMNIKSFRKPNSKKSREFLGKIKG

SEQ ID NO: 6604 - protein, 235 aa, Methanobrevibacter ruminantium
MSYDFDDFDEDFDDDEFDESEDYDDFDEDFEDDFEDDFEDDFDDFDFDDDFDNLDSKSKEDIDIFDEKPLETDSGYERTAVEVHVSSPLSSRKLVELMDTYPSLKRITCPKSIYDRMSSKYIKILKEDLNITVEIKYNWGKKKYTKKEVDSVIELFNEGKRSGEIASQLDMPISNVNYIKSKYSDRINVKHYKKKYDDECRLRIKSMKEDGLKPKEISQNLGIPVRSVYYILNKK

SEQ ID NO: 6605 - protein, 4929 aa, Methanobrevibacter ruminantium
MNNKTLFIIGLFICLLFTIPMVSAADADSNLIDNSVIGTNINSQAITTSDASIDHSSNANAINTNINSDDIVSNNNNNNSIIDINDSDIESQKDGSSKNIIKSTNKNTNDSNNETEDNILVTDINLGKNNKNSNDKNILSANALTADGTGTTFGDLQYIIDQDTTGTITLDKNYKFESGTDDAYLDGITINKAITINGGNHTIDGDHLARIFNINTGSASDIVVLNSIHFINGMADGSGDNANGGAIYIGSPTTLNYITAINCTATGNGGAIYAHADGTNIAANYLYLYNNTAVNGGALYVYGNDYTVTVVDARYNSASGNGGAMYAYGNSFHLNKVNFINNTAYGEDSEGGAIFFAHNSDDSIVNNSYFANNSANRDGGAIVWDQGAHFGELYNSKFYNNTANHSSGAVRWSGENGTIDNCSFIDNKAYGTNLEPGDFDQGGDQILGGNGGAITWLGSVGIIRNSNFTDNYAEANGGGMFLIAFDINDPNSICNDTHIINCNFISNDAGLNGGALDWDGKAYNGSVSGSKFYNNTAARSGGAIFWKGNGGIITQSDFKYNSANGTHLVQPEGFLTPGGNGGAVIITGSDVNITYSNFTNNSARARGGAVYLQLNNNTMVLNSSFENNSAGTNGGALDFYTGAENGKVINSTFLNNTANRSGGGIYWNGEKGVINGSIFYDNKALNQGTYVNGSQITDGGDGGAIIWTGSHGTLENSTFKNNNATNRGGAIFLEKHNLEDPNDYCKNITVLNCTFEKNSAGTNGGAIDWFEGAENGRIINSTFTENYARRSGGAVFWNGVNGTISNSTFTLNEVGLEGADTGTGETIPTGDDDGGAIKWTGANGLIENSIFRENKALEGRGGAIYLENNENGTVNNCTFELNSAFTNGGAIDWHEGAKNGQLINSTLTNNTAGRSGGAVYWNGHNGTINGTNFTDNKALGTHHTEGQTEGGDGGAIIWTGSYGTIELSNFHNNSARWRGGAIFLQKNVHEGEEHCYNTTVKNSYFEENFAGSNGGAIDWSAGAMYGKLINSTFINNTAERSAGAVYWNGLYGEILNSTFENNTAIGNFTHDVRPEVDETYTVIGGNGGAVVITGSHAKIDGSNFTFNTATRLGGAIFFHDNTNGTINNSIFTNNTAGLNGGALDFYEGARDGQVLNSTFINNTAKDGKGGAINWIGTNGTVDGCDFINNTANGSDDESGAGGAINVDGINTYIANSTFTNNSCWDDGGAICWNGDLGKIYNITCFNNSAIGKDHKSSGGTISIYGSNLTMDKVNITLGTVSSVNDDKVSKGGGIFVTGNYVNITNAEFTNCSALAPIDDSSAGALYIIGNNTNVVNATFKNNTAYEDGGAVYILGENCTLNNTLFLNNVAHNDGGAIQWDGNNGRIYNLTADGNYADSASGSSKGGTLTIEGNNTVIQKINISNSYVDSDHDLGAGKSTQGGAIFLTGNDCNITDAVFDNCSVKYVADESSGGAMYIIGNNTNVVNANFTNNSAVEDGGAIYIDGDYCTLNNTVFINNTAHNDGGAVDWEGNYGHVYNLTAIDNHADSAHGSSKGGTILLEGGHCTFDQLNISNSYVSGETYTGTKPVQGGGIAISGNDCNISNSVFDNCSVRYEGTNSSGGALYIWGNDTHIANCNFTNNSVPSDGGAIYVGGSDVTVVDSNFIDNNASQSGGAIFLTDNKNSQINGSTFKNNSAKVNGGAIDFYAGAEDGLVSACEFVNNTAGASGGSIYWEGTRGVIEYSSFDGSRALGNQTSDANNGRGGSIIWLGDHGTIRGCDFNDSQSAKEGATLYVVGDLIKVQQSNFTNSQTNTSGGIYIQGSEGTISNCHMENTTAKESGGALYVKGNYIYLLDSDINNATSVNNGSAIYITGNTTHIENSNVTNCSSSSGNGTIMIAGYKTVMDGVNVDNNKAVSAGAVLISGSQTKISNSNFTHNNASKDAGGIMINGTDNTITTSNISDNYAKENGGGIYYTGDRNTVSYSNIDHNSANNGANVYMAIKAKDCKLIGSNITNAKARNFGGGVEWCENSENGLIQDCYFYNCTSTAHGGAIHWYPGKYGVIDNCTFVECHVAGTKNGGAIYAGANTNVKPVGTVLSNSTFINCTTGTRGAVNWNSQGGLIYNNTFINCGVANTSVTTSWGGAQALQIEKGNNTQIIACEFYNCSGIGGGGALRVQGDGHSGYNITIANCTFDNCNNTGLAGGVYLSDMARNITFENNTFTNNSAPNVGAFFMDPKTVIVSFVNNTFINNSATGSSGYAGAAQLTGNLEVINSTFIENSAVSKAGAINAVEDYDGNNNLAIIGSTFQYNKAKEGSAINAINLDMTDTVLLENQAAFDKWTNQRNSRANGHVSINGTFVGKDNYLNGIKANGATFDNVTYCGVNGGGLYEDTVTNTDDVTSAKSTNEVHQLIVLEIYDYNNNLVDTKTTFTDENGKFNFEFDMENPQDYSYKVIHPEDNYYTGAEYSIGKAISNITIKSQNITHPEDENITFKVTGGSGTPTGNITVFINDTEGNVIFNDTIILNSTGEAKLFFPRLNASEYYIEAKYNGDNNYLPDNDTSIFHVNMAESFIKIGIENYTYNETRNITITVPYIESGRISVIVTNENFTQLYTVYVNEGTEEVQIQLPILDAGVYDIEAIFHGNNNYYPSQNTTNFTVFKAASIINITADNVSGGVRETVDIHIDPEVATQNINLTVYDAQGNIVDQYYDLGLHDSRITQILTLLPKGKYNVTVTYPGDKNHNASSNSTIFYVTNDLFPIEINATNMTYGDDQIINITVPANADPDKLYININCSDWPGNKTVTELGLTIDENGLIQIDTTNTNLFANKIDAGNYTINVYYPGDDDFLSNSSSVDFEVAKAIPEMNVTPTNITYGNLEDILVEIAQNGNVTLYVTSENDPTLNITKIEVEIIEGKVYWNVNDTYLPAGEYMVEAIFNGNRNYESVNKTEKFNVTKAIPNIVIDVDDIHVGDSEYINVTVEGVEHGTTPQGNIKIIVRTIDQIVELNATGQYNLTLDDEVQGNGISVTVIYYGDDNYNYTEKSVYYDVTKKETSINVTGATPISYGTIENLLAEVNETGVTGTITIYVNSTVDGFINQTHVATITVDDAGKATWDIDQIILPVGSYDVTAVYSGDDKFEGSVSTVKVIVVEKATDYDISVEANNTVYGTDQVIIVTVPDNANGTVTITIEGTEISLTSQVENGKAVFTIPNDLVDFLEVHDNYNVTATYNGDDKYAAGVKASDLFNVTKAESHIKVVAEDIDYTQIENITVILPDFNATGKIVITIVNKSDTTQIVRTLEVDPFTNTTGVIYPFEGLLVGNYTVKVEYSGDHNYNNSENTTDFEVRKVDPTLTENSPDIIYGADENITVTITGATGGVDPTGTIQVIVDGVTIDTITIGDKDLEFIVTKPGVDPQHNITVIYSGDSNYNPVTITGEFAVTQNNTIEMEEVSPNIVYGNNEIITITLPNDATGTVYLVVNGTYYTPIGIDENHQAVFTIVAPIVGEYNFTAYYSGDENYTANNISGAFNVTKADVSLSESHTATITYGANDTITVTITGVEGPEGVLAPTGTIKVLVDGEEIGNVTIGDDLVFNSIRPFVDPQHNITIIYSGDNNYNSKVIDNTVLDTLVFEVIKNNTLEISEDSPDIFYTENETITVTIAGDATGTITVTVGGEQVGEVVTITEITEDDKVFTFNITKPEGGVYDDLTVVYSGDSNYDSATINGEFTVSPIDPNITEDSPDIVYTNNEVITITVPEGATGNLTVTVKNSKGDTVETKKLVIGTDDLVVTIEKPAVDNYTFTVDYTGCTNYTEKTITGEFKVTKASNEITVVSTNITYGQTETITVTVPEGATGNVTITVGTYTDMLEIPEGSTEVVFTIPKTAADELLSVSDNYIVFANYSGDSNYESVVANAPFHVDPANTTLTIEVADITYGEDEIINVTVNGVTGGDIPTGFVTIKLNGTDIELTKPVDSEGKVQFNVSGLVVGEYTVNATFVSSSINYNDSNNTAKFNVTKADVKEANMNITAINITYGDDETITVILNETNITGNVTITINGTEIETKELVDGKVVFTVPDLEVNGYNVVANYSGDHNYNAIPIGANFNTDFKVDKANVTVVVTPVDIIYKETEEINVTVTGVFINDNVNDNLTGKVTIYIDGVENQTKDISAVDEYGILHFSVEGLAVGTHNVTAVYHDDRNYNDNNATEDFEVINALPEDMKVIPQNITYHIQTETITVDLGEVLNGTVQLYINDTLVATFEVIDQRTVSYTNNSLAVGNYTAKAVFTANGDFVNASANFTVSKAPVTVDVVAEDSVYGETQTITVNVDNTVPDKYNLTGNVSITINGVDYGNKTVDANGQAVFEITGLEANDNYQVIATYYNDPNYLDNTGQDTFKVSKADVKDVNKNITAINITYGEDETITVTLNEDNITGKITITINGTEIETKELEDGKVVFTVKDLEVNGYNVVANYSGDTNYNAFTIADNLNTDFTVGKANSTVEVEAIPSIVYGNNETITVSVPIRNHTGTITLTINGSDYVFVKHLTAEDGDTIVLTNVSGLAVGNYNVTVKYSDDRNYNDSEASALFEVTKATPSQITVEAQNITYTEDEIILVTVADENATGSVTITIDLGDSTYTNTTNLDENGQAKFNVTGLVVNHYTVVANYSGDANYTGQTASAPFRVDKAASNVTIDVANITYGEIEYANITIPNYNASGRVIIKVDDKAYDILPINNNTPVKLELDGLAVGTHTIDVEYFDDDNYNKSVAHVEFNVTKAIIPVDPANASSLIVLPTNITYLNNETIVVSVGANNATGKVTITIKDKDGNPVDIDPSVVTSKNITEEGSQSVTFTVPGLAVGNYTVEVDYTDDANYENAQTSAKFIVDPANSTVTVEAVNITYLDNETITVTVPITNASGTVVIKINGTQKDERTVS

SEQ ID NO: 6606 - protein, 2719 aa, Methanobrevibacter ruminantium
MEGLAVGEYNVTVEYSNDPNYNNSNASTLFHVDKANIPDVPNTEGLVVIPTNITYLEDESITVTLDVPNATGKVTININGTDIETKEIGGGTVTFTVSGLAVGEYNVTAKYTDDPNYNDVNASALFNVSPAASNVTVVPTNITYLENETITISVNVTNATGTLVVKINGTEVNTTTFTGEDKPTIVVTVPDLAVGEYNVTVEYIDDPNYNNSDASALFHVDKANIPDVNPDTGIVVVPTNITYNDDETITVTVNVSNATGKVTIKINDTDIVLSKNITEDGSQTVTFNVPGLVVGDYNVTAEYTDDANYNDVNASALFKVEPAASNVTVVPVNITYGENETITVSVDINNATGNVTIKINGTAVELTKNITEEGSQTVTFNVPGLAVGEYNVTAVYHDDVNYNESNASALFNVKKSAPVNLTVTATNVTYGENVTVTVTVPDDATGNVTITIGDYTDKKEITPGSNTVEFTVPNLEVNNYVVYANYSGDSNYESGIVNAPFHVDKANSTVIVEATNITYGEDETITVTVPNNNATGWVTVSVNGSEIGSKKIGTDGKATFTVKDLEAGEYEVTVTYDGDRNYNGNNNLTRFTVDKANITEDNITVVPTNITYLDNETIAVTIGVNNATGIVTIKINGTNIELSKNITEDGSQTVTFNVPGLVVGDYNVTAEYTADHNYNDVNASALFKVEPASSNVTVEAVNITYLDNETITVTVPITNASGTVVIKINGTQKDERTVSGDNPTYNITVGGLAVGEYNVTVEYSNDPNYNSSNASTLFHVDKANIPDVNPDTGIVVVPTNITYNDDETITVTVDVPNATGNVTIRINGTDVELTKNITEDGSQSVTFNVPGLVVGDYNVTVEYTDDANYNDVNASALFKVEPAASNVTVVPTNITYLDNETITISVNVTNATGTVVVKINGTEVNTTTFTGEDKPTIVVTVPDLAVGEYNVTVEYTDDPNYNNSDASALFHVDKANIPDVNPDTGIVVVPTNITYNEDETITVTVDVPNATGNVTIKINGTDVELTKNITEDGSQSVTFNVPGLVVGDYNVTVEYTDDANYNDVNASALFKVEPAASNVAVVPTNITYLDNETITVTVDVPNATGMVTIKINGTGVELTKNITEDGSQTVTFNVPGLTAGEYNVTAVYHDDVNYNESNASALFNVKKSAPVNLTVTATNVTYGDNVTVTATVPNDATGNVTITIGDYTEKKEITPGSNTVEFTVPDLEVNNYVVYANYSSDSNYESGIVNAPFHVDKAPSHVEVDGIDINYTDLETITVTVSDNNATGFVTITINGTDIELTKEVSAGQAVFDVKDLVVGEYNVTAVYHSDRNYLNSTASDTFKVDKSDVKNMTISPVNITYGENETITVRITDNNITGNITISVNGTEYGPVELDNGVAVFNVPGLIVGDYEVTASYSGDSNYNPASSTETFTVDKEKPNVHVVSENIDYGKNETITVIVDGFNVTGNVTIKINGTEIATKEINDKGRAVFVVPGLQAGEYEVVAIYNGDDNHESSEGSDTFTVATVTPNMDVETEDIDYGDNETITVTLPKDAKGSVNITITDENGTVVYEGEAQLEDGKATVDVPGITPGPYNVTVKYPGDRNYNPTNKTVRFNVDKVVPDVDVDTVNIDYGDNETVTVTVNPVDGGVTPTGSVNVTVRDSDGKVVYEGNVDLVAGKATLDVPDLGAGDYTVDVRYGGDSNYDDSTGGSSFNVAKVSPDMDVQTEDIDYGDNETVTVTLPKDATGTVNVTIKDNDGNVFYEGEAELKEGKVTVDVPGLPAGDYTVDVAYGGDDNYNPVNSSDSFSIDKVSPEVDVGTENIDYGDNETVTVTVNPVEGGSAPTGTVNLTVKDSDGKVVYECQADLVEGKATVDVPGLPAGDYTVEVAYGGDENYTATNSNGNFAVGKVNPDMEVDGEDIDYGDNETVTVTLPKDATGTVNVTVKDSDGNVVYEGEAKLDDGKATVDVPGLPAGDYTVEVAYGGDDNYNPVNSSDSFSIDKVAPEVDADTEDIDYGEDEPITVTIDPVEGGSTPTGTVNVTVKDKDGNVVYEDQVDLVDGKVTLDIPDLDAGDYTVDVAYSGDENYTARNSSGSFTVNKAKPELNVDSEDIDYGDDETITVSLPEDATGTVNITITDKDGKTKVFNDVPIENGKATISVPDLDAGDYNVTVDYPGDDNYLGSKATSSFKVVRSNSNITLETENITYGDEEPITVDVNPVEGGVTPTGTVNITITDKDGNTKVFNDVPLENGKATVDVPDLAAGNYIVDVKYSGDGNYDPDSTEGAFEVAKAVPHIEIHVYDIYYGDVEVLTVTCDAPGTVDITVNGVTVTVPLDDGYDKRVFSSIVRAYSGKATLDLVNLAVGTYPAKAVYNGNENYTSVSDNDTFHVYKENTTTKISVDDIKLGEDAVIDIEVTHEDGSEKINTNITVTVDGKDYTVELIDGKGTLTIPDLDLGKHTVKAVYPGSHNYTNSSNATSFKVTKVTPSFDISTENIQVGDDETVTVTLPDDATGTVTLTIDGKEYTATVENGKATFVIPGIKAGEHKVNVAYSGDDKYAPAKRSDSFTVSKVKPDMGMDAPEIKVGQDGVITVTVPEDATGTISITVDGKTYTASIKDGKAVFHISGLGPGTHIVKAYYSGDGKYLAGSVDGTIVVEPKNGTSPQDKGKAHGGIDLESKKTGNPILVLFMVLFSLILIPIKRRRDDDEEEENEDQINRID

SEQ ID NO: 6607 - protein, 46 aa, Methanobrevibacter ruminantium
MARPISPTPTLYGEDARRFLKKMNEPPTEKEKKFWKEVESQRFVPF

SEQ ID NO: 6608 - protein, 74 aa, Methanobrevibacter ruminantium
MDSQYIKDNYYFETLNESHNLNNFYCEDEELNEFLKEDALKQQKQKLNLTKLIICDDEIIGFVSLLRWNKNKRY

SEQ ID NO: 6609 - protein, 168 aa, Methanobrevibacter ruminantium
MIKTDNKGQITVELLLLLSFTFISIIALTNIISDANEVNIAMAAARNGAFEGASSNGLAIYPKDTFDNYSKDKRKEGLFNMKNIKIIKIAQTFKGKDNFNKTRIQLKVYASSKIIKTKEEKESAGDRINYNMRRAITNSFKTENISNRLFNPAFSDSYSFTTANVEWV

SEQ ID NO: 6610 - protein, 447 aa, Methanobrevibacter ruminantium
MVIVSYLNPLSSEGQNIVRGLSSLDDIFAPNDDLIDIVIHSPRQTISNQEYVPETLADLAINRIKWYIDKKNNKDFNPSNYAYFFNEEIAEYDTIAFHILAQAVASQFRAGSREIKLFVESYGLLVEDRLIRLLETEKRELVEEILGDFLVQDGIEWAFLKDLVASKRISLTDLVLDNGKIVLDREEFVYTFGDEFTDRSPERIYDILIGDGLKEMIVSKLLIQKSEEYVAHIQDMLRTIEPHPAIVRLGEMLGETITELMTKYSSFYAAGGAYGNMEIGKLVREAFPPCIANTVEGVSSGGRNDAIVLLLTSFVSYARLYPGIFGADASVKVSDIDSNLNITMNEILPLIYEAADNCTPPLFEDQPQEKINITSKLGFGMHETPELEHEGETKWYTPMSCEKIKMHLPQLCKENKDCAKINNPLSYYSRMRWILSKKGGESKSEEE

SEQ ID NO: 6611 - protein, 97 aa, Methanobrevibacter ruminantium
MNMSFEEYAVMAINHHIEERNKYLKKEIKAKEEEIQAIDEKIQAKEEEIQAIDEKIQTKEEEIQAKEEKINKIRKLFKDFCENEDEEAMNTIKSILL

SEQ ID NO: 6612 - protein, 368 aa, Methanobrevibacter ruminantium
MVNLKKLNQISTENNNTVSYYETEEGKVYKVLVDENGELKKIACEEFPFEPAKQFKKEKINKVHDRIFKFIAENNIQAFLNVFGLKHIIFKQFLNVEILDQTLNQSYCDLVIEAEDGKIYIIEFQSSGPAKKDKIRFGDYQTTLHRKKKGQKVIVIMITINDDPDNDEPYGYDKEYRYRINKRSTTCFNTEKVIKELEFKAENDCFDDEAYVKLQLLYYMESNGDERKKLLKKGVEIKNKIKNLSTDRKVGLTLIYMALAVHNFEEEELERFKEELKMNMSIEEYAVMGINHHIEERNKHLKKELEEKDKEHKKELEEKDEEIQAKDKEHKKEIQAKDEEINKIRKLFKDFSESGDKKAMNTLKTILL

SEQ ID NO: 6613 - protein, 163 aa, Methanobrevibacter ruminantium
MLSEEELRRLIESLTIREIIEPALDNWTRYESTGKTVIDLKSGRVYGISLKSNELLELDHDNNHIELYKIESHEDLFDEEDLLSEDEYNRFQEFKDRKELEDEDFDDYDPELLSEFCMMESIDEKERIISILIEDYQEYHFNNYQDFEHSIILNYYDEDDYTY

SEQ ID NO: 6614 - protein, 330 aa, Methanobrevibacter ruminantium
MYGPSSLAERRIYYREEWSDKDLPDFIAQGITKREFGFDHLGNGPNDRYKVFKGTDTLRRFLRYKTPFAAYISVAFYQNPRKRGGWEKAEYIFDIDAKDLPIRSCNCDGVCEICLGEALERVNIMLDTLKGDLGLKNIHLIYSGRGFHIRILDPDMMEADSDLRAEVLKYVAGAEVPRAQYPNIVPGAKPLNFEHFSIPIAYPAVFTNKVKYNIFHLRGDETIDGINNRLLKDIIKNREFLIDDKWGLFKERIGPRRYKDMVNAMARVNLATIDAKVTIDLKRILRLPSSLHSKVSMKCVEVKNPETFDPFKHAVPKFVYERKDEEIAQN

SEQ ID NO: 6615 - protein, 100 aa, Methanobrevibacter ruminantium
MSKRVLVSFALIFICLFSISAAWALDMDSSDLNKNIGTNLENNFNTDSNNNLDSNLNSNFNSNLNSNIDNSTQELDLSTKNFKALSSNSSIGGGQIALLI

SEQ ID NO: 6616 - protein, 1490 aa, Methanobrevibacter ruminantium
MDGSYSNLTNLNFYTNATSENSNYLTPIYINEASDLVIENNPIYIDYSDGCNYNLAGIYAFGASNNNIIGNNRISIYSRSLSNTSKHYIYGIDFSSYSSNAYSKDNAKGNDISSNTIDIISDYYANAITLSCAVDTTLESNSLHLKSDSFVYGMVAEYFDFGNGLNPSNNFNFTKNTIEASSNMVYAIQFFNVFDVNIKENTIKTNSNGSYGISAYESYNHDIGYNNLFVNGNDVSMIGTNFDAIGTGHSGIYYMRDSHDLSIHDNNVLSNYSLGGDYAIRFDASSSENINVFKNNLSSNNGKYLGNDAVNGNVTVSENNHYYGDNDLGTNDLRIFDIYVDLNGNDNKGDGSIGKPFKSISKALSYLKNLTNIYGSSASSSSTTKVKGIIHLGEGKYNGYGTNLRIYITGLDVEIFGSGYNKTIIDGVSSHWFFDISEDSSVSIKNLSLANGVYRYNDGGLIHNKGNLYLENCIFDNAKMSPSSAIIYNDGILNLKNNLMNMTANGYHIYNNGFIDGLYLNFIGDSLSEDERLLNTDSLSFILTAYVHDDNGNPITGGYIRFFIEGKEILVNSSLIEGLAKLYTFSSLNGIIKISGYYSNAYTNLFVNIGKVNSSIISDTIKVYVNYSANESKSDGSFEKPFKSINDALDALNTCIEPVTITVLDDETTEQIDDSRLNRNNVITIESINKTNISTNWTFKSDANIRLKGLIFDGYGLVKDNTYLTIDNCLFNNTPASAIVSTNGSLTLLNSNFTNNNVKDNHTFYTGFSTPVITTSLWDIQYDYDKGGAVDNSFSNLTILNCNFAFNEAYNGGAIFNNQSDLHISNSSFTSNLAFSGFYENPRAIDFSNAMDKDQDRNVASKGGAIFQYLGEEVVVTDTGFLNNTAGGYGGAFYSSGIYPYRNDSSSIIEGIPFIVYETEDGLMDNFGNYADNLLSPQDIYFINCNFDSNVAPIRGGAVYCINNSQTQYISCNFGNNLVYTYNMSQLFGGLNKNSHRKWIFEDELDQVYSIFFTAVNNGGAIHDENLKIIDSTFTANTLQSGGSILLPSVIRYSADVYTLPKNTAGAIITNSGKGGESVYVADSSLLTSEDSKYIGINGWTGTSTGGSIRRIIHENGQETGTGGNGSGTGGSGNGSGTGKGAYGNSLSWSDILSALGGDARGIAINGEGSSFSDFISGLINGKSSSNSSSDSQDNGSGSSNSSSQNPVNGTIPSNSSSDSQDNGSGSSNSSSQNPVNGTIPSNSSSDSQDNVSSSSNSSSTKPMDDSNKTNSTSDVPANDTVNATDGSSDSSISENPVNGTASNDNNSSDVNGGASDMDDDNISNLTNSSSEIPVDTNINDTNNSSSENSNSTTDLDDSEDKSDVDKDDKSESDDVGLSDNPLNGDVSESSDSPDSPDSPDSSESSDSPSSPDSSSSDYQSSSSAASPGDSSNSPSSSSSSSAYKIYEEEIDDNILEKNVDLENLLIIIVLFLGLIILGYYKKSKEDEDN

SEQ ID NO: 6617 - protein, 2201 aa, Methanobrevibacter ruminantium
MSYFNKGHIWNILLICLLIGTLAMMGSASASSANLDDFSNLACDSNSYNDLSVGFESDANSYNDLSVGFESDANSYNDLSVGFESDANSYNDFSTYFESDSNSYDISDSLVNSNSDRLVNSNGLIEFNISAPNDIQLNDKAPIKNSLKEYDERVFYVSLDGNDFNNGLSQENSFKSLNKALENLHDANKTTIYVFEGTFLSENSYDLFFEGVGNSQMISIIGSGVNKTILDGEGLHRLFNVDNSINLTLRDLTFVNGFDFSSGGAIYNKGNLTLVNTCFYNNNVYSEDAYQHVSLLSGGAIENEGFLTIENSSFIKNSVGSVFNQYAYGGAICNHGNLTINNSIFNNNSLETYIDLNENSYFRKWNALQTGGAIASFSDGALISNTEFSNHSISILNKYPFVQKTFMTFSAGGAVYIEGNNHNFINCSFLSNDADNGGAVYFKGNNTCFDYCDFDNNSAFMGGAIMTIDYNLNEAWMPTLKNLTSNKYSNLNISNSNFSNNHFICTDFGIGYRISPGGAAGYFKIDNITIDNSSFTNNGVLENCTIFVSSRCGGAVFLYGQDSKVNNSSFVHNNVEVGGAIMNYGFDTNVSNSKFINNSACYSDGGAIFHSIGDLLIDNCDFDYNRAVKNGGSIQASYDYTNNYLFEQKSLYNNSRFKNSAAEYGGAIFDMGNAVLYNDLEFINNSASYGGAIYNQGFSNTFRNSTFVNNSAFSEDYSNGGAIYNYGSNALYESSIFINNSADMEGGAISNFGESCVVQNNTFNLNKAFKGGSVYLSGQGGRFQDNNVFSSFAIYGGGLYNSNINLICLSNSFNNCSANVSGGAIYNLVSTLELYSNSMNDCKAKLSGLGSGNYVFTCANISYLVISFANNGSFNIVDNKGVLLVANISDNMGNPITGGNFTFILFNQTNQDIDLIGSSGSSSSNSSNPSNLESSIIGVCDVVEGQAFLRYDTYLELGSRYTISGTYSYAAEPVLTQVANLNSVLSTRMYFSSNITDDMVNFGEGFNYEIILLDSNDNYIPNAEILLYVDAVYSKSVFTNEFGYLKGSVNNLTSSGKHFYSFIYSGDIFHNRASYDLNFTVFYNNSYYYDDVSISFRDLIYSFVYTSPNSEIPFEFLISHNDGVPLGNVSTPRYFVAYENGIPLASFSCTDYLGVCKGQEVLYSIIELNGKLAKIFRTSPEGIFQMLIKHSERGLYEYRIAFLGDLVKHYDSSTHNGISNEDTFYNPCNISFLMLVDDEQSTIPTSLNYNGPNKITEVDFAYYNFSLSENSKNPLANKEIRVYDDGNYLGSSYTNSKGFAEFNFPQMLDKGKHIISFVYVADGDYKSAYSIFELNVLENPSKDNVSFFNKSSLNITGANNNFTAQIKDSHNNNLSEMVIRLSILFNGSDNKPYIKNYTAVSDKNGVFSIPLELGAGSYLIKCSFAGNKHYWKSSKTFNLTLNKVPTLLFGQSSVEVLKNDTYLTVILSTNDLKSLSDSKIKYLVFDSNITGLNLSYNDSSELIRDISNYAYTFYAFTNESGISKLKINLPVGSYYLVSLFEGDKWYDESSLITNLTIYGSSSRLIANENVIVKKSGYYTVKLVDGNGNPIQGQTIEITVCNKTYTRFSDSNGEARLAINLNYGNYSIQSKFNGTLNYSSSIVASRLYVVDEDYKYPSILTVNSSDIYRAFGYYDVVLSDVNGNPLPEKSIIVEVNGTGFNIKTDNNGLAHLDYNFTVGRYNIVSHFVGDGDYQYSNVGSILNVVNENAANTLLNSSIYWVLKGKGNNYTVTLTDKIQNPIEGQIIVFSINGREYSRTTDKYGNANLAINLNPGSYDIYAFYRGTDVYYSSETYSKLVVLALENENEGSNSSSAIGSSNSSSNNDSDVDSTNTSNSGNSETNLTNGSSSGDSGIDNINGSSSGDSGIDNINGSNASTNISNSTGAGNDSSSSGLDNINGSSSNISNSTGSDNNSSSSGIGGNLTNATVNDGTSISGNSSVTNGSSNLSNNDTINKSDKPVIIPKRTVTKIICHNMTTTAVSKADGRVGKYFEVSLIDANGKPLANKRILIGFNGRKYNRTTNATGGARLQINLAYEGKYTFAIAFLGDDYYSGSFEVALITVNKHSPKLDASSRAYKYSDKTKSLTAKLLSANGNPISGKNIIFTVNGKNYAAKTDSKGLARVNVSLNKKGTYTVKIKFMGDSSYKSASKKISLRIISPSER

SEQ ID NO: 6618 - protein, 280 aa, Methanobrevibacter ruminantium
MSKGYPNFYDRMMKNIASYDLKSFFLFFGLDCIPYFSIANEVVDGGLNLSLLDLPVCTSKGIVNFEFQFDRDEADDRRFIRYGVQLYEKYGFPVMSVVIDFKAQEDEPFPIEISKGCVFTIYVKSLNERNPDIVLNNINDKLAINEKPLGKDLTGLKLLPFLDLDRKIELLDKATEVLFSLDKNLVGLREIKHLMRVIMFYSHQWNYEENLDRLGRWSIMVDDLSQDAVVHFGKVNRKKGREERSYEVARYMIDDGFSAEDVSKYSRLDLSIVNQLMLMK

SEQ ID NO: 6619 - protein, 1124 aa, Methanobrevibacter ruminantium
MSRKSKEKYEWDYSTYSKVDPKVRSYFPFAKARPQQLETISEIHEAIEKGYKYIVLEAGTGTGKSAIAATLAMCYGDAYILTMTKQLQRQYTKDFEDYDFALVKGRSNFDCLKYMEEAIEESCDMGRCVLEGHKCSYKVNQFNLYKKDPGECCPYFHQRAIALNSDIVITNYSYLFAELNFNNDFKAKRLLICDEAHNLESKIMDLISLEFTRRQLKDEVGINLSKETLKDLDEKGYTSWLQFIKRVCERYGDKSKETKKALGKRKSLTLHRRSENLKRRLEDFKRFSNYIAIDPDNWIMDYDPHSQKLSFKPIRIDKYASEVLLKHADVCIFMSGTILNHHQFAKWLGIEEDEIYPIRRKSPFDIRRNPIRTYSGFDMTYRNLGSSAKRSVPVIREILERHNGEKGIIHTVSYQCKEFLKKELNNPRLLDHETKDREKVLEKFKKSDEPLVLISPSMNEGVDLPGDLCRFQIIYKIPYPNISDKQTNIRRKKEKIWYDYQTAINLVQTYGRGMRSEDDYCTTYFIDSRIKSYLKRDSIRNNLIPDFFKEAVDVEAAEIEKNPIRKASDASAIAKYEGSEFSDGSDNDKNLKIDDSTSKSQKDSKNTFKKSDVRTKYALMKKGKDLARTNKKEAIAFYKSLLMHKCFKNDYYPYRKLVVLYDKTKDYKNELGLIKFFFNRGIHCPRLYYFWFLNKLLKLSERGLITKEEIKELEKEYMSKGFKNKSVQSSSMIIADRIEHYYGDTYVLSEHKFNNKLKSKEIIEEGKYFERTGNYQKAIDLYSEAIFDRHFNNYSFYQRICFSLEELEDYERELEYINSYFDNDSIKKSETSEKWFNKRLDKVNGLLELKNNEKNISSEVKSSDEDSILNPSNIDLMEYDDSLSLEDNIQRKMELKEHAMELRRNKNYSELISFLNALTKNSYFENDYYPFRHLCSIYEQIKHYSSMKDSIKDMLYADVYLTDYQLVWLKSKREIVDAQIGLDDVLFNQWIDHYKSHGARNKSKANSPVPLADRLIKKDENYNVSTSEEFDFTQKKYELTEKGRSLERKGRYEEAAEFYMDIIKEKKYHHYDFYKRLCFSLDEIPDYERELKAIKLYYTCPPIFTDDTSDRWFEKRLEKVNSKI

SEQ ID NO: 6620 - protein, 165 aa, Methanobrevibacter ruminantium
MGKITNRKEALSKRDQIEKLQGESFEGDDNIDWFGRIEEIVIDDDYCIYQIGKYSKLSNYYYDDFEEYSKEYGQENPLNLCFEEIISYLSKIVLGDFGDNVKAECIGKGGIVEVNGLNFHPVSRIDIADLNGESFVYLYDDNDLIARIPFFDITSYKITAPEESV

SEQ ID NO: 6621 - protein, 54 aa, Methanobrevibacter ruminantium
MGVNCIRVVIDNAEESITKVAKAHGNGALVLVPKRWIGRKVQITLLEEEDKLMF

SEQ ID NO: 6622 - protein, 200 aa, Methanobrevibacter ruminantium
MNSCAVDVKENSIESAMGINTSESDSFQLNTISSVDIGDKFKSSGATNYLESIKAWKNIEKIIDCLVPSDLEEVFSISSNNNFKINWDEKALYDVLYTNESSIFVPLGCMEQVGNGYYIMNHKDMVYSNPDDFIHENGVYGLIIRFDNNMIQSEYAYCEYNSGLSLDGENCDFVKMDFISGEDTVENYIFDSLNGFNLFN

SEQ ID NO: 6623 - protein, 138 aa, Methanobrevibacter ruminantium
MYYYKLESFDYDEHWTAFYVSNKKYSDDEFKKIVKDAYIETCKHISENQKPVSKFNYMIDSVIFDILQESDKDKSQPCHYFNRILKDRHDLINLDDCLDSKLEFVEQNGGNDNLREFYDKRSEYILVGISDDDNKGYI

SEQ ID NO: 6624 - protein, 490 aa, Methanobrevibacter ruminantium
MNYEFILNDLRPSQEEIDAVNKTTEKVISFLNKTCKEENIPAQAFAVGSVAKNTWLSGKSDIDIFIRFPLKTDEAVLKEKGLYLGYKTNDALKGKASEHYASHPYLTCLIDGIEVDIVPCYWIEDGSQLKSAVDRTILHTRYIQKHLKKSQEDEVLLLKKFMDAVGTYGSEFKTGGFAGYLCELLILKYSTFEETLRQAQDWKFHTKIDLENYGTSDNKLFKNDPLVFIDPTDKNRNVAAALRIERMLDFIIASRNYINLIDSLEDADENIIKEKVLKYFSPLLKERFQDKSVKEISDDILDEFKDRETQTLVISFPIPEMNADALHPQLLKTVESISHKLESEDFSVYSYDYWTDEKNLVIFIIELNVFKQSKYYVHEGPKVWNKLAFNNFSAKWSQESLYHKGEFIVFDRERQFVTAKELVKHLLEKDNIHEIKVGKNLRKAISSTHTLCEIDEFLENIDQFICDEADQREFLNTLDDLLRPGQYLKR

SEQ ID NO: 6625 - protein, 154 aa, Methanobrevibacter ruminantium
MNTEKEFNTTVYNYDRLGDLLFIFQKNHKTYLNNLLAEYDLNLIQVLCILKIDSEENLNQKDLSDSLYLTKGAITKAIKKLESNGIVIREKSPIDKRHNVLALSKKGEDLIPIINDINQDWEKRMGLDELSPEFLKTFKALAFKSAELNNEKLV

SEQ ID NO: 6626 - protein, 312 aa, Methanobrevibacter ruminantium
MSIKKVVVAGGGVLGSQIAYQSAFCGFDVTVWLRSEGSIERAKPKFERLLNIYLSTLEAMKTDKSAYCRGLSKTADLSDEEIDSLKEQAQKAFDSLTLTTSYEEAADDADLVIEAIAEDPNQKIAFYEELRKYLPEKTILVTNSSTLLPSMFAEHTGRPEKYLAFHFANNIWAQNTAEVMPHPGTKQEYFDAIVEFAEDINMVPIKVLKEQPGYVLNSLLVPFLSAGQALWANEVADPETIDLTWRLATGAPNGPFQILDVVGLVTAYNIVIMDPRSNDPETTQGKIAAKLKEKIDAGETGINAGKGFYEYG

SEQ ID NO: 6627 - protein, 227 aa, Methanobrevibacter ruminantium
MIVSVIGGTGPQGLGIALRLAIEGVEVIVGSRKEEKALDVVAEAKEKYADYDLNIKGLANEDAAKEGDILILTVPLAAQKPTVEGIKEFCTDKIVLDATVPLETAIGGKPFRFIDLMEGSAAERTASILDGTGAKVICAFCNISNSHLSNIPEDIDCDCLIAGDDKEAKEIAAELINKIPGVRTIDTGILEKSRIIEKITPLLIGLNIKYKSHYGGLRITGIPKLDE

SEQ ID NO: 6628 - protein, 498 aa, Methanobrevibacter ruminantium; identical to SEQ ID NO: 5951

SEQ ID NO: 6629 - protein, 169 aa, Methanobrevibacter ruminantium
MNAIFKRKSIRKFLDKPIEDEKIERLLRAGMQAPSAINSQPWEFIVVRDKDSIKTIENMSLYSKPAKTSTCCIITLFNKKYTDKFDDYCWVEQDMGACTENILLQAVEEGLGAVWLGTYPNEERVNYLKEHFDIPDNVYPYSVIVLGYPTEDYHGESRFDESRIHYETY

SEQ ID NO: 6630 - protein, 173 aa, Methanobrevibacter ruminantium
MDLLDVMLKRRSVRRYTDEEIPEEKLNKILQAGMLAPTSRNRKPCSFLLINDKDSLVELANSKEHGAELLKGAKQAIAVIANPNVSDTWIEDSSIALAFMHLMAAEQDVGSCWVQMHLRKSKDGQWSEELAREILGLDDYFRIVGILALGMADGQPKPHSLDEIDLNDVHILH

SEQ ID NO: 6631 - protein, 191 aa, Methanobrevibacter ruminantium
MKANEKETIRSFLAIELDESLVPPILDVQGDFKKTDTKIKYVPAENMHFTLKFFGNIDEDIVEDISGAVEKIIKNYSSFELKIENCGCFPNQKVIKVLWLGIDKDSKITDLQKELDKEFKKLGFKKERNYISHLTIGRVKSPKNKNEIRDVIEKNKNIKIGSMTVNRVCLKKSTLTPQGPIYENIRVFDLE

SEQ ID NO: 6632 - protein, 266 aa, Methanobrevibacter ruminantium
MTTNIGKRIRLERIFNRKTGRTVIAPMDHGVSSGPIKGIINMDKTIEEISQGGANAVLMHKGIVEQGHRGYGKDIGLIVHLSASTSLSPDPNNKVTVTTVEKAIQLGADAVSVHVNIGSENEPEMLMELGEISETCSYWGIPLLAMMYPRGQKVENEHDVEMVKHAARVGSELGVDIVKTNYTGDPDSFREVVEGALVPVVIAGGPKIDTDRELLEMVRDSLEVGGAGVAFGRNLFQAQEPGKITKAISEVVHNDMDVEEALKILK

SEQ ID NO: 6633 - protein, 368 aa, Methanobrevibacter ruminantium
MSPKTSWDDKKELITTALESGIDHVLDLEDSENIRKVGNFNIISTEEDADVYLVGIDGEGDGTLELKDNLNESSDLAKAKEAKNSGKTVCAYIIITDKLHEQLAVVLGKVVDYIILVGTDWTVIPLENIIADLQKEDVKLLAAVSNADDAQVAMETLEVGTDGVIFEARDFAQIKDIAGLIDELSTESYELKDLTITNVEPVGSGDRVCIDTTTMMRPGEGMLIGSYSKAMFFIHSESLESEYVASRPFRVNAGPVQAYVMVPGNKTRYLSELVTGDEVLIVDKDGKTKTSIVGRSKIEKRPLLLLEAEYDGMKIKSLVQNAETIRLVDENGEPISVSNLEKGMKVKGFIDDSARHFGMAIDEQIIEQ

SEQ ID NO: 6634 - protein, 421 aa, Methanobrevibacter ruminantium
MNPKELFAESKTIIPGGVNSPVRAFEPYPFFVKEAKGSHIIDTEGNDYVDHCLAYGPILLGHSDDDVMADVYNQMKMGTAYGAPTENEVKLAKEVIDRVPCAEMVRFVNSGTEATMAAIRLARGFTGRNKIVKFEGSYHGAHDYVLVKSGSGAACLPDSAGIPEDTTKNTLSVPFNDVEALTKLIDEEGENIACIIVEPVMGNIGCVEPNVKYLKFLREITEENDILLIFDEVITGFRVSRGGAQEYYGVKPDLVTFAKVLGGGFPIGAYAGKKEIMSLIAPAGPVYQAGTFSGNPISIQAGLSTLNKLDYEFYGNLARKGDYLRTNISDIVEDLNLDLQVVGLASMFQIYFNPEPVVNYEIAKKSDAKRFLVYFRELLKNGVFIPPSQFECNFISGAHTEEDLDKTAQGIENALKVAWQL

SEQ ID NO: 6635 - protein, 212 aa, Methanobrevibacter ruminantium
MNQKDYWNSIADKKEFTTPFHPEILENYLNKDDFIVDIGCGYGRTLRELKDNGYRNLRGYDISEKMIERGKNENPDLDLRIKDPDTIDLDDDSVDGIILFAVLTAIIDDEEQKALIDEIYRVLKPGGILYLNDFLLNDDERNLKRYDEYKDELGVYGAFKLPEGATLRHFDESYIFKLFDSFEKREYERQIYPTMNGHTSNGFYYIGEKNIG

SEQ ID NO: 6636 - protein, 412 aa, Methanobrevibacter ruminantium
MLMNEQTKLSKDHYMIFGLSWAGWVFDFYDLVLFTFLISQLQSSLHINAEMLALCLGLSLFATGLGGIIFGALGDKYGRKKVLEWTILVYSIGTLLCAFSWSFYSLVLFRFITGLGVGGEWATGQIYISETFPDNLRAKFGAFMQSGAPVGVILASIVGGMISPIIGWRMTFLVSIIPAITIILIRRYLKESDVWIKNKDDFVNKNIFQEFKQLVSKEYRKIFLISLVLCIFGMSAYWFTYSWLPTYLAEERGLAMVTTSLGIILIQCGDFTGYTTFGFVAERIGRRPAFTIYSFIMGISIAMITICWNQIDKVPDLIMVFMFLTGFGTGFFGGFGSLFSELFPTKIRNTGVGTVFNLARGVQFITPMIITFVGAYYDLSYGIAIAAIFAFLVGIWIWVFPETKGTAINDLD

SEQ ID NO: 6637 - protein, 180 aa, Methanobrevibacter ruminantium
MKIIALLASPRKGGNCDVLMDEMIRGAEENGHEVVKYFLEKCDIAPCKACMFCAENPDCVREDDGNEIINALVDADGVIFATPIYYGQMSAQGKLIIDRFYAIGQNPDKSLGGKAALIFTENQPEGTYKDYIELTKFSPFTFMGYDVIGHVDAGSAGPAGIVAEEQKDKLEEAYELGKLF

SEQ ID NO: 6638 - protein, 262 aa, Methanobrevibacter ruminantium
MINIVAGLGENENIILASRQLESIDDLNIQLVDNEDDLFDAFKDSNVGAVVRGSLKASKVIKLIKQYKSDCEVNRATYVNTSNDPNFNDSYEFLLSPVGIDEGKNIDEKITLAIQSANFIQSLGKTPKIAVLAEGRKDDYGRSERIDKSLKESEELTRLLEERFNSLDNFDNSSEDVSKNYQIKNYYILLEQAINDKFNILLAGDGIFGNIMFRALVLLDKWPSYGAVTLGIDEIFIDTSRDQTVEGYKRSLELAYNLAKLK

SEQ ID NO: 6639 - protein, 254 aa, Methanobrevibacter ruminantium
MPPQFLYKIYEKRLMNELDPDRMPRHVAIIMDGNRRYSRMKGDMEVIKGHELGADTLEKVLDWSIDLGIEIVTAYAFSTENFNRPEHEVEGLMRLFVENFKKIVDHEKIHKHKVRVKVVGRIELLPDDVREAIKEAEDSTKQYNERLFNLAIGYDGRLEIVDAIKKIYKKVEDGEISIDDIDENLVSENLYTAGLEDPSLIIRTSGEERLSGFLLWQSSYSELYFCDSLWPELRKVDYLRAIRDYQERDRRFGV

SEQ ID NO: 6640 - protein, 253 aa, Methanobrevibacter ruminantium
MIDTHCHIDFEEFDEDREELIKRAQDKLNAVINSGYSVESNNKVLELSKEYKDFIYPTFGFHPVSSQNSPEEEISAAHNQIVTHLDDILAVGEVGMDFYYCTDKALRARQQEIFMGFVEIANEYNVPLLIHGRDCERKIFNLLNDYDDIPKVIFHCYGGSLKVAKRILDKDDYYMSCSTMVCYSKHHQELFKNIPLERILTETDSPYLAMTKEERNEPANVVYAVEKLAELHETDVSEVDEQTEKNARYVFDI

SEQ ID NO: 6641 - protein, 226 aa, Methanobrevibacter ruminantium
MKPYVILNAAMTLDGKIATKTGSSEISGKEDLERVHEIRKKVDGIMVGIGTVLADDPRLTVHKINARKEDNPIRIVVDNKARTPLNFRILNDDAETIIAVSSICDERNENCDEEAVKRAKELEKRVNVFYSTGETVDLVEFMEYLYDYGIKSIMLEGGSTLNFSMIRDGLIDEVKICIAPMIVGGKDSKTFFDGDGFDYMKDAVQLELINSFPLGKDFIMEYKVLK

SEQ ID NO: 6642 - protein, 48 aa, Methanobrevibacter ruminantium
MGNMAEARRKMHERDERIKKENKSDVKKIRNFFFGCCDNKEKKKVKEH

SEQ ID NO: 6643 - protein, 214 aa, Methanobrevibacter ruminantium
MHSLFSDGELLPSELARRALVLGHEAIAITDHVDYSNINTIPEISAAIDDINSNWDITVVLGAEITHAPTESIPALAEKARELGAKIVVVHGETLNEPVVEGTNFAAVNCKEIDILGHPGLITKEEAELAKKNDVALEISARKGHCLGNGHVANIAREVGNDLVIDTDTHSPDDIITFERSIEIGLGAGMTKEEILKATIDNPRKILKRNGIEI

SEQ ID NO: 6644 - protein, 352 aa, Methanobrevibacter ruminantium
MISVFVPSHITGFFSIHDNPDPLLKGSLGAGVLLDKGVITEIDFKENFDLGGVNDNDLNLDSLNSDELLIIINGKRDEYNEVIILKTIHLMKKALDKEDISLSGVVINQIIQVPIGCGFGTSAASALGVAISINELFDLGLSLEECGQFAHLAEVELGTGLGDVIAELSKGIVLRTTPGAPGYGEAKSIVPHEKTGFGVFESLNADFYIITKSLGEISTASIISDPKHKKLITQVGEKTAEEFNKKDDGIVIGSKFKNKFNVAVDSEFNEEETIKKFMKSSLFFARKTGLISDELLELVHNLHGKVIGSSMAMLGNTLFAIATEEQKLKLEAEYYGEFDFYKLETEGIRIIK

SEQ ID NO: 6645 - protein, 177 aa, Methanobrevibacter ruminantium
MIRLSYDMQVYRKDLREVLKRTDNVVELGCHVGKTSELILYKLTTGSLIGIDNSPEAVQPLERLSFHHENFTHIIGDVRRHEVLKEVTELIGQCDVLSIDLGGGYHPDTVFKVYYIWASTLKPRDVLIRNQGLIDFVNSAITTEDMISEHGWLESCGDQGIPPQIKEFSLWTDKLDD

SEQ ID NO: 6646 - protein, 440 aa, Methanobrevibacter ruminantium
MDYLLRDLRRTHYSKDVNPDISGEEVIIMGWVHEIRDLGGIIFVIIRDRDGLVQITAPSKKVDAEILEELRALRKESVVAIKGTVQEAGKAPNGVEIIPIKTTILNPAKQPLPMDPTEKVKAEIDTRLNSRFLDLRKANVSSIFKIKANMFKAVRQYFDEQGMIEINTPKLVASATEGGTELFPITYFEKEAFLGQSPQLYKQMMMGAGFDKVFEIGQIFRAEEHDTLRHLNEAVSIDCEISFADDVDVMNVLDGMITRVLQSTKENCAKELETLEYDLSAIPEGPFPEVKYDDAVDIINSKGIDMEWGEDLSREAEKALGDTQEGFYFLTDWPSAIKPFYAMPYEDRPEISHAFDLMYKNLEISSGSIRVHQYDLLVKQMIERDLNPDGFGSYLKAFEYGMAPHAGWGVGADRLAMVLTGVENIRETVLFPRDRHRLTP

SEQ ID NO: 6647 - protein, 426 aa, Methanobrevibacter ruminantium
MEILRYERETADELIKRSQADINEILNIVQDILSDVKENKDEAVKRYTAKFDRCELDDLQVSDEEIKNAYDNLDTDLIDALKRASQNIEKFHKAQIPEEWSMEVAKGITAGQIIRPINSVGCYIPGGRAAYPSSILMEVIPAKIAGVERIICCTPPGADGRILDAILVAADLAGADEIYKCGGAQAIAAMAFGTESIQKVEKIVGPGNVFVTGAKKLVYGDVDIEFPAGPSEVLILADKTAIPEYLAHDFLSQAEHDPEASCFLVTDDEKIAEESNDLIERFTKEAVRKEIIQESLEKHGHIILCKDMEEAIEFTNTYAPEHLIISTEDDNAILDKIKNAGSIFLGKYSPVAAGDYGSGTNHVLPTSGGAKMYSGLSTESFIKKPTVQTITKEGIEELSKTVIPIAEYEGFYAHANSVKVRLDKNE

SEQ ID NO: 6648 - protein, 101 aa, Methanobrevibacter ruminantium
MYKDEMIQLHQFLVYVLKYLDTDNNAHEYIEEYLALNISPHHIHRTKAEHKQAIFVLSNTISEVILHKEEGSIPPNVSNALRDLVRRSKKELKAAEAAQSK

SEQ ID NO: 6649 - protein, 462 aa, Methanobrevibacter ruminantium
MSTRKVVCLVDGEHYLPVTRSAVNSINSIDHIEVVALVFIGGTEKLKLGDEEEYSELLDTPVYFGKDKNQIPYKLIEDVIKKHNANIVMDLSDEPVLDYDKRFKIASVVLSCGVIYKGADFEFEPLTQYEIMKKPSLKILGTGKRIGKTAVSGYAARLIDKNNYNPCIVAMGRGGPEEPEVVHGNEIEINPEYLLEQSNKGIHAASDHWEDALMSRVLTIGSRRCGGGMAGDVFVTNMDKAAKKANKQDAKFVIFEGSGAAIPPIKTDKSIVLVGANQPIGNILGYFGPYRIMLGDLVILTMCEEPMASKEKIKEIEDFIHKIKPDVDVISTVFRPKPLSDINGKKVLFVTTAPEAVRDVLSSYLEETYSCEIVGLSSHLSNRPLLQEDIEKYKDDVDCIVTELKAAAVDIVTKEAIESGIELVYCDNIPVPISDDYPDLSESILKVVDGAIEEFSFNMLLD

SEQ ID NO: 6650 - protein, 353 aa, Methanobrevibacter ruminantium
MMSQDSNKNDINSYDFPSRVEKALKLIHTDSFKALDYFNEILDDFFKFTPDEIKENNLSSLIINSLNGKGSILNAFDKIDEAEECFDMVLNDFDSQDFTSLINKALILRKKGHLEESLDYYDEIAKYYPDKKELILAMKSEVYGELKIKLSDTDLDDYSIEAKDLIGRGLASHENKIVLEALDYYQKAIKADSSCKYLVLSLMDDVKREFFKLFLYEDIDIEKDEISKKKGAVLHYLFIQNNLFYAYMLNEEILEENKNDLFALNAMGMIFFYLDDCDLSIRYFDRCNTIDEKYLYPYLNKAIALARAKRFDEAKESFGKIKGLPNLIRDPNEEELDIFKRTIISNSIYSLGF

SEQ ID NO: 6651 - protein, 146 aa, Methanobrevibacter ruminantium
MSHVEKSLELFEAKFNCAQSVFCSFSKEFGLDEKQALKIAACFGSGMRKGEVCGACSGALMVLGLKYGQSELGDRDSKLKSDKKCTDFLEEFERANGSYICNELLGCDIRTEKGVNYAKENNLFIEFCPKFVESATLIVEKILKEE

SEQ ID NO: 6652 - protein, 359 aa, Methanobrevibacter ruminantium
MGDSLKVIIDAANVAHYQKGENSKAKLKNITLAVKALEQGHHDFLIIADASLRHNIDDKDTFVRLVEDGIIDEVPIGNVADHYILDLAYDENAKILSNDKFRDFMSEFPDINSMRIPFSIKDNELILGKTKKPKKVKNLLQNICDEILNELERKRWVVYKGKETTKFTPLNVAKQAILILDQSERDDMSSKIEGIFSKLPMFDKVMEMVDDVETSVPYVIFVLVHPKDYKAAVKDAGNISVTVADRLRLVHKPLIAVRNDLFIKPGYFGLNIVLTDEVEDIPPFNIEIQTNTYDEVFIKKNSRNIASTIAGRLGSWKFPFVSVKPNMILEKPGEFEIYLEKNSKKKKKDKSKDKDKKKK

SEQ ID NO: 6653 - protein, 397 aa, Methanobrevibacter ruminantium
MCLVNGVRAAGSRQGKYGLAVIESKDSNASAVFTSNKVVAAPVIHTKEMIKGGKISLVVANSGNANCFTGEDGIVDCDKTIDFASGITGISRSEIATASTGVIGRKMPMDIILPLVEESISKLEHSNEASTDAAKSLMTTDTYHKQFAVETSIDGKKVTIGGVTKGVGMIAPNMGTMLCFLATDASISAEYINKALKTAVNKSFNMIVVDGDESTNDTAILMANGKSGVEVVNDGEINPDFQEALDFICISLAKMMARDGEGATKFIECKVNGAKDENDAILASKSVISSSLVKSAIFGGDPNWGRIVAAVGYSGCEMDQNMITVIISDDNGKEAILVDKGKILAFEGTPNLDLAEKIMQEKNINILVDLYQGDASATAWGCDLTYDYVKINAEYTT

SEQ ID NO: 6654 - protein, 213 aa, Methanobrevibacter ruminantium
MNDYLNNSDTNDALVKLPAKQIGKNEIGTVSIEGPYGNTSSPVKVAYILGQHPREFSAHDAIYYALQNNSNELNYSYYVYRINVTNETADFEQSRMNGQLLAQEFVVNDSINKSYDLVIDIHSSNGGYIQDPYIFAPVSSDLLAYDAANNITKALPYVTYYEPASYTSPQYSTIPLEEGGIASIIFEMRGNPDNSLEHQADDFVKAVDKLVLN

SEQ ID NO: 6655 - protein, 394 aa, Methanobrevibacter ruminantium
MIINGKRSLAHVEKVAWIKPIEGADNIGLIGVLGWTCIAKIGEFKEGDHCVYIEIDSKVPEKEWSEFLRAKKFKIKTMRLGKFKVISQGLALPLDKFDVEIPKKVGTDVTELLEITYSNPKDIKRKSDGPNKYEEMARRRKALFRKPWAKWLMKREWGKRLMFFIFGNEKDGSKSFPKKFEYVHKTDQERCENMPDVLKDKTPFIRTQKCEGSSGTFILELTNSRLGKREYEFYVCSRNLRVFEDENTDFWDVAVKYDIENKLKDYLEKHKDCSYVAWQGEVCGPSIQNNPHKLSENHLFCFHMIDSEKGMFDIREAKELWDEYEIESVPIDEEEYILPDDFEEFKLTADGFYDPEVCEGQKKCRREGFVYYKTTDPNFSFKNVSRKYLLKIGE

SEQ ID NO: 6656 - protein, 203 aa, Methanobrevibacter ruminantium
MGNKTGLLPANGHRIQGRSSESFLDAREIIMELGLEGNEVFMDAGCGDGHAAIEAVDILDDDATIYAVDIYEPSIEDLQKFAVEKGYDNLIPICADIPDYIDIDDDTVDMILLINVWHGFKATRRMDEAIEELKRILKPGGKIAIMDYKKQEAKHGPPITVRSSPEDLEEVFKEHGMCLFSLNPDTGEDIPQGKSHYLIIFQK

SEQ ID NO: 6657 - protein, 292 aa, Methanobrevibacter ruminantium
MESINLLVEALPYIKKFYNKKVMIKYGGHAMVDADAMASTARDTVLLKYVGMQPIVVHGGGPEITRSMEKLGKEPKFIKGLRVTDEETIDIVKMVLVGSINTDIVSQICHHDGKGAGLSGKDNKLIQASKTMHEIKDDDTGEIEQIDLGLVGKVDKINPEILEMYTENDYIPVIVPIGIAENSKTLNLNADTVAGAIASEVDAEKLIILTDVPGVLRDPNDPSTLIQKIHIDEVPQLIEEGIISGGMIPKIETCVEALNNGVKSAHILDGRIKHTLLIEIFTKDGIGTMIYK

SEQ ID NO: 6658 - protein, 247 aa, Methanobrevibacter ruminantium
MGKLDGKVAIITGATSGMGRESAKLFAKEGAKVVVCGRNEERAAAVVDDIKAAGGEAIYVIVDMANLDEVPKIYEATMDEYGTIDILFNNAGVLSMSPLMDLTLEEWNKVFNVNVTSALVLTQLCVPVMKEKGKGTIVNTCSVASFGAHHGFAAYVDSKHAMMGLTRSMAWELGPEIRCNGIAPGLIHTAMVDSIGGPGALQNMIDQCPVKRCGEGQDIAELALFLASDECTFLDGQIIKCDGGFEI

SEQ ID NO: 6659 - protein, 494 aa, Methanobrevibacter ruminantium
MLNITTFLDANACRLEKEVFYYPNRELRYNSKELLTIVSGIGQSLKDKNIEKGDRVLIYLNNSPEYLFSLLAIWRIGAIAIPTNRILTSAELDYMISDSDAKLIITDDEARETIKDLKINSYIIEDCESFKDSEVLPAEETEWDDLCQLQYTSGTTGKPKGSMLTHGNWFTAIHNACDVLTYKEDDTFLCIYPMAHVGILWAIAALRAGALCITMDFFEINEYLRLCEEEKVSVLSGMPPVIHTLTNLEEEKRENLSTVREIISGGGPLHRKIWKKFMGQYNIPIINAYGLSESIVIGTGTVIRPEDYATADRYESVGHPVCFSELKIVDEDDPNKTLDKYEHGEIALRGPAIAKGYWGMEKETKESFLEDGWFLTGDIGYIDEDNRLFITDRKKDMIVMSGWKIYPTEVEETLIKYPKVDEIAIFSINDIHRGELPVAAVVWKEDEDPEGLLEYSREYLARYKVPRKIFTMDELPRVNGWKLLRRELREMFSQ

SEQ ID NO: 6660 - protein, 332 aa, Methanobrevibacter ruminantium
MIKIARIDGDGIGKEVTEAGVAVLESLDLNIDFVEAEAGRECFDKNGTTIPEETIRIARNAKATLFGAITSTPGEKSPIITLRQELDTYANLRPIKSFKGVDCLFDDLDFLIVRENTEGLYSGKERLEEDKAIAHRVITRKASERISRLAFQEAIKLNKESVTCVHKSNVLKKTDGVFKDSFYNVAKDYPQIKTIDYYVDATAMYLLTKPQEFDVIVTSNLFGDILSDASAGLVGGLGLAPSGNIGDKHGLFEPVHGSAPDIAGNNISNPIAMILSVSMMLEYLNEDYLASKVKTACENVLEKGKVLTPDLGGNAKTMDVANEVIKEIEKLD

SEQ ID NO: 6661 - protein, 155 aa, Methanobrevibacter ruminantium
MEKSIDELILDLKDEDDFVREEAIGSLELKGEEAVCPLIEALGQRNKDIKIGAAQVLAAIGDKRAIPALVATLGDRNKLVRREASTALTTMGDEAIEPVIAELDNPKWRVRGAACWVLGALDAKEALPKLEELLNDESSFVQYGAKDAINRINNG

SEQ ID NO: 6662 - protein, 120 aa, Methanobrevibacter ruminantium
MGLYEHDLNDLLKSLEDKGLVHYEGSYVQLRDFEGVINTVDSKEDVLTAELNQKEKKSFEIIKSLADENNLVSRYEIEGNLLYGDLKLTDFRMYHIILSLENKGLIEAVYKHNGDYYKIL

SEQ ID NO: 6663 - protein, 263 aa, Methanobrevibacter ruminantium
MDKAKVNNIILNYNLEGEGRTIVFIHGLSDSLNYWRPLQESLKGDYQTLSFDLRAHGESGDDRKEITIDLYQKDLYYLLNYLNIEKAVLIGLSLGGNVALDFAINHPKMVDGLIIMSSFSEFSDHLNEIFDSFEEAIEQGFEEFFDVILPYTLPEDVLKKHEVELEYVKKEGAKTANIEGIKAGIKAGYSFSITDKLNTIDAPTIVIAGADDELTDLELQRKIYDNIDNSEMIILEDTKHNVLIGKNISRILDIINEFMLKIE

SEQ ID NO: 6664 - protein, 164 aa, Methanobrevibacter ruminantium
MRISMSLPKKLLAEFDEVLKDRGYQSRSKGIRDALSDYILRYPWMNEMEGNRVGVITVIYDHHFTGVMENLADIQHDCMEEINASMHIHMTHKYCMEVIVVNGNVTHIRELAERMMRLKGVEHVKLTSTANGESLDREPGLEHSHSHSHSHLIFFLKNFFFLFS

SEQ ID NO: 6665 - protein, 311 aa, Methanobrevibacter ruminantium
MILITLSFLRDYERLAVFKEAIDEFAISNLDKDLDCSNSNGDINSDDDKKLDCSLAYDLGCGSGVLSYLASDYFDKIISIEQNRSIFKCANKNLKSFDNIEAINQNVLDFDFENYPKADLIICEMLDTALIDEEEVPILNHSKKYLKENGKIIPQGIINSAEPVFMNIDYLQYEDDEYQPIYEILGKSVIYSEFEFLDDIDEDFSCIIEFEIDDKYSDKKTDASFEVDDRCSDKTDYFNKSNDKIKVNGIKLTSFTKLNENIICGPTPMLNPAMLVPFEEIEVNNGDKIRIRLSYVMGGGVETIKTEVLDV

SEQ ID NO: 6666 - protein, 174 aa, Methanobrevibacter ruminantium
MLNLDEISENIDLFLEDCSSLIVLGIGNDIRGDDGLGPYIINQLTDLKENLSLKEPQSLENVHLLNGGSVPENFTGLIKRIDPSHIIIIDATLMNEEPGFIKIVNKEDISNVSISTHSMSLSYLVKYLEIEIDFKLIFIGIQPKDMDLTFELTDTIKNSSDTLVDLLFSKFLKI

SEQ ID NO: 6667 - protein, 379 aa, Methanobrevibacter ruminantium
MKVLFIGSRLYDDLAYHVDELGIESIITESNEEAPHLDLASKYYIVPRGMDKPMEVAIEEKVDAIIPLIGIDPPLKDLAIMKEKIEKENNIPVISSNFNAVDIASDKIKTKEFFKSIGLNVPEAKVLNKDDFSNEGEFLEKLGFQFPIVLKQGEGQGGKDICITSQFEDVLQYFESFNQALVENFIEGAEVSIEVIGWNGEYLPLVPVYKGDTSLEGIHPIKRLRYGPCDFEAIDNEEFRQLAKKIAVNLGSEGTIDMDLIYSREENKVYAIEINTRPSGTRYLSYATTGLSPLGLLVDIAAGNFDVKDLENKIKHYYSLEIPIGDYEGPAPNEPVKEYVNGNFIVHGPKGYQRITIRGNTREETYEIAKELTGNDYRS

SEQ ID NO: 6668 - protein, 357 aa, Methanobrevibacter ruminantium
MDLNYIIVLFVLTFLATVAFTYFVRHTLRDADVSDSPIVSEHRHKAGTPTMGGIAFLFAILFIVSIYYRNTNILIASFIMLTGGVMGLLDDLLGLKIKEYQKVVKNVSDSVVPIGLLDLGPGEEARVTTDKAKKQVYGYVDEGKLEIVAEIPIKYEPSEKTKIIVQLLPGLFLALTGVVTTLGGFTLGILAYPICIIAILGSINSINLIDGMDGLAAGIVAIASFSCCIYAYICGNMDMIPAFAILTGICLGFLVFNRYPASIFMGDTGSFVLGTGYAVAVILGDIPYFGVLALAVPIVSVIISLMHRAHIINLPVEPLHHTLNYKGISEVKIVLSYWLLTVLVCAIGILAKLYIFA

SEQ ID NO: 6669 - protein, 539 aa, Methanobrevibacter ruminantium
MSKTYFLNELADSISSQKTFSIAQLADAIGGKIYGADDYKSPNGFTGIFETLNEAVEGDIVIRHWINGKGVEIANDKNVACIITLTPKEDALEMASKLAFPVIVVDRIEFANAFALKWTIDNLSPNTQRVVISGTNGKSTSSHLIYHILNHCGYNVFTNTDAKSEFNTLIDPMVAKLISEQVISKQDFDVRKLDSVADLKNLDSEGKPINKGAFDYIVVEVSEVQGWGSDLMKDHAQIMSSAINPDVGVVTNVAMDHIGLVNNIEEVFHETSGLVKAINKGGVVLNYDDENVLAMKDLANDGVDIFFTSMEKDSILNNDYDNDKKVYFDRKSNAIVYDNKNILRYDELPFTGEHFIRNILSAISACISLEIPIEDICEGVKTYNPLSRRFTRLYDEPIVIDDFAHNPDGIKNTVRAAYDLAEQFDKGDLYIACAIRGSRGETLNGLNSEALALVIKELRHRNDDDIEKDENVKKREIYLILSSSCDLVDHLNYVEDFERGYISFSNLDKEHIKYIHFNKLYGALGYIMKKCIWKMMLYC

SEQ ID NO: 6670 - protein, 617 aa, Methanobrevibacter ruminantium
MGEFVFSFLEDQFRDIYLDCARMDKNLIEGDGVESILIAGRIAEKITKAIFVFEGIKDNEDNQYLRIEKLSNANILPNNIKNDLSQIRILRNNVYHNTLNSDGSGGFASYNAPKYVQSGGLRDYKTGFNEIKEYSKISKQNSNSNSNSSSNSSPNNEFGSELTAAREAHKLVFNVCVWFYVNYSGDKDFIRPKYKLSRRTQDADFLIRLKSAINDGNDFIKLRQNNPNNEIIQILNEIYVKKAPQEPKEEQVYGINNKDIKIRQPDVPYSKCLGISYDDELFMWHAEHGGKDLGLFESSKEAYEAREIYINSIPMPRKVNGAYSKARGISFSRIQKLWSASVKGQIISYHGSEAEAIMARKKYLKSHNLVDIKVKDGYKTITLEEKAKLEEKIRQKKESSKSDIKTIPSNSNTKDEMEKENIQKIMDGVKKLKDDLNESSASTYIKSSSLSSQSSSSDSVSSYSGSKSSSLGSTSSSSKSGSLNSKSTSNENSSFYDIHNIGSGDKTKKKVKIVNGSKVQASQTTKKVKVSAGNRVSKKHKSSSKNSTVSNNANSSKKSKSVAINKKKSSKYEGVFYEDGLFMWSAEVDGKHLGLFSSEKEAYEKREEYIKNKSNNN

SEQ ID NO: 6671 - protein, 197 aa, Methanobrevibacter ruminantium
MSKFKYCPMCAEPRADNSKYCSKCNFEFLTGKYVKVQEEEIKITEKVSQEEFVESNQLIQDTSLKINVLISRYLNYSLSNKFNENLPLSIIREYISSCLNSKVPSDFDDNYLQSLDALLNDEGYKNSINLFLQWIDENRSHLPGLVLNQYMIPHQNNVNRIEEILDLELEKNEDNDLFFDLLNKFLISEKEFIERLI

SEQ ID NO: 6672 - protein, 62 aa, Methanobrevibacter ruminantium
MPVVRISGNPNISVETKREMVKKVSEIVAESYNLPIETITVLIEAFEREDIGAGGKLLIDRD

SEQ ID NO: 6673 - protein, 278 aa, Methanobrevibacter ruminantium
MIEISDKFYDKTFKLFRYKNFENLCSNCGIFIEFDGFNDKELVDDGGITYIMDISINDKRGYSVIIEFQSSVVDEADIERFMKYATLTYIQYKKPVEIYVLSTVEEKNRVIRRRWNFFNEFTICVKSLKSIDGDKVLNSLKKKSRFDEDFTGDDIVDLLTIIFMKSVKTTVELLKEICLLVNEINALDEKELYDIKTFLLMYVKKFVEDKQEARILEELIGMRNDLFGRTWASVRNRAFLEGEARVVRCMFNEGIKIEEISKIVGLEESQILKMIGSS

SEQ ID NO: 6674 - protein, 152 aa, Methanobrevibacter ruminantium
MLGEIELKKLFPDFEDLVQPSGIDLELDEIFIQKSEGSLIDNEKNLPDIEAMEGPIYTLKPHTAYLASIRRKVKIPKGYTMLYLPRSTLLRSFISVQTAVGDPGFYGTLMFMIYNHGDFEYKIKSGDRIAQAVVFPVEGSGEYNGSYQEEEI

SEQ ID NO: 6675 - protein, 381 aa, Methanobrevibacter ruminantium
MVEISIVIPVYNVEKYLRECLDSAVNQTFKDIEIICINDGSTDSSLDILKEYQESDDRIIIFNQENQGPGAARNLGINKSKGKYVYFLDSDDYLELNALEKLYNICEEKSLDFVLFKLLNFNDKTGKTFQTKYYNMAFLNDRIGDNVFSYKDLYDCVFNLAVSPPAKLYKRELITDIDYPEGIIFEDNVFFLKTLLKAKRIYFLDEFLYNRRRRDDSLTSSGSDDYYDIIPSMNYLFDICRDLDDFELLKEGLYYKKFKELYIRFSKVNDVHKEEFFNLIREDCLKHKEEIDEDIANDKLRKRSKFIYESVLSSDDYKEFHYRIRLYDKNKEINDLKKENKSLKNENKKLKSSNKKLKKENKHFKSTKAYKVWKKYSKIKD

SEQ ID NO: 6676 - protein, 328 aa, Methanobrevibacter ruminantium
MVEITLGLPKGSLNNVNRGNTYQLFVDAGYEVRGYEPGNESYEINILNDSEIKAFLTRPQSTPVELNRGMVDISIVGEDWVKEESVLSDNDIVKIGDLNYGETRLIVAIPKESPYDSLSEFFRANADRERPILVFTEYPNLTRKHIMENEAYQEIYGDAVPFVQVRGLRDGDNKKVQVINSDGATEVYIAKGADLIVDNTQTGSSLRKAGLKELETILHSSAGLYAGVSCTEEKMVKAKMIYEQLLGAVTARKYFDVKFNIANEDIEKVSNYLIENKFCSHEPTVNHGSSFSQINVLIPKNIFPEMLDGIKELGASSIIRSDVKQYVI

SEQ ID NO: 6677 - protein, 308 aa, Methanobrevibacter ruminantium
MLTSVQKEILQTLINLYQNSDGKSIKGEDIAEVMNRNPGTIRNQMQSLRSLSLVKGVPGPRGGYKPTIEAYHNLNISVSDSNAKVPVYKENKKMDDVSVAKIEFTSVPHPGECEAVIKVLGSIKDLHLGDVIRVGPTPVNNLGLIGEIVGRDDMDNILLLDISTIRSIPKNTVFDIASLDLIYLKPGDSIKDAAYLLSHNQIDGAPVITEGVAIGMVSLIDIVNALAEGKENEDVRDIMSKRLFFINKDTLIANAVYKMYKFGISRLIVVDDEHAPIGVVTRTDLIETITNFKNFPLLYNMEMDEEME

SEQ ID NO: 6678 - protein, 311 aa, Methanobrevibacter ruminantium
MKVNQISIKKDMKVSELMEEFKGSGVLGAGRVARASNLLVNMINDPDMDIFMSMAGPLVPGGLRYIVGDLIRNKRIKVLITSGANITHDLLESFGGRHYRDLGFNDEELNDAGIGRISDVYTQSEDFEVFESEIIKIFETISKKIDNDKDNGIISIQRLLKEVGSLIEDENSILRLAYENDVSIFAPGLIDSMFGLQLWMFTQDHKLVVDAVGDMHYLSDLVFESDKIGAIMLGGGLPKHYTLASNLLKGGIDSGLQITMDRPETGSLSGAPLEEAKSWSKAKHGSNLVTVVGDATALFPLIYAAALDKID

SEQ ID NO: 6679 - protein, 215 aa, Methanobrevibacter ruminantium
MKVKNNIILAMDLMDLASAESVCESINQYIDTIKIGYPLTLAEGLKTIGLFKENFGYKVICDYKVADIPATNEKIANLTFDAGADAIICHGFVGPDSVEACKASAEDHGKEVFLLTEMSHPGAIRFLQKDADDIARMGVEMGISNYVAPSTRPDRLSEIRDIVGKDSFIISPGVGTQGGDPKETLKYSNALIIGRSIYNAEDPETATKDIIDSIQ

SEQ ID NO: 6680 - protein, 256 aa, Methanobrevibacter ruminantium
MIFAAILAGGVGNRMGEVDKPKQFLTLGDKPILIQTVEKFYLNSRIDEVIVLCHKYWLNHTKDLIEDYIPNAENIVVVEGGELRNDTIMNAVKYIEDNHELSEDDIIITHDSVRPFVTHRIIMENIEKTQEVGACDTVIPATDTIVVCHDGNIISDIPNRNYMYQGQTPQSFKILKLKECFNKLSDEDKRSLSDAAKIFVLNGEEVAIVKGEVFNIKITYPYDLKVANTIIDDAKLNISDAETGEYKVNLYDFGEE

SEQ ID NO: 6681 - protein, 340 aa, Methanobrevibacter ruminantium
MINIVYRLVAPKLLEEVYTELNLDVGVIVRPKYLSICKADQRYYYGKRVPEIIESKLPMALIHEAVGTVVKDNTGKFNVGDNVVMIPNIPRARDNIISENYIPSSKFRSSGYDGFMEEYVSLTEDRLVKLPDDLNMEVASFIELISVATHSIKRFKQFSHQKKDVLGVWGDGSFGYITSLVLKVMFPESKVYVFGMHREKLHMFTFVDETFLVDEIPDNVSVDHAFECVGKASANNAINQIIDIINPEGTIALLGVSEFNVSIDTRTILEKGIRVFGTNRSAREDFVSVVNLLEENPNMIHYLESLITEIVEVNTLNDIKRAFESDKNLRFGKTVIKWEI

SEQ ID NO: 6682 - protein, 1012 aa, Methanobrevibacter ruminantium
MKKNNFNKKITFVANYFWTSIKEGSKSNSYFNYDNYLKKYPDVKESGMNPFKHYLLHGIDEERSTNFDENINSYSLVENSDLFDYEYYCEKNNLKFDSYSKALMHYLEKGYKKGYNPSIKFNAEEYYEVRPDVKRADVNPLVHYLKYGKIEVTSMTENLNLKEYQLVKNSNLFDYNYYMEKNHLDLRNETEAIYHYLEIGYKKGYNPSNKFNGEIYFKKNPDIEESGWNPLVHYLKYGQKEERTDKCDKNLKEYSLVKESGLFDYQFYKDKYDLDLNSYKRGLIHYLEFGYKRGYKPSRNFDGEEYLKRYPEVKKAGFNPLVHYLKYGVNEERIGLRRISFKNFNKNYDVEAILENIDNDVTILLNVEDSNNLKECIENIKSTTKDYKIILIHENLDDEDLEYIKSNNDIELLRRSPHESFINALNNILDNAKNDIIFLKNNIRTFEKWIFKLTVAAYSDDRIGFVSPISNYSTVSLINIEEDEKSSEFISNISKRDYEESPLPNDSCVFIKKDVFKELKFDESSNEENWFATFIDRGLEKGWKSILDDSTYVYYQFNEVEPQQADEYDYSTPYVLENRPSVKFINSDAFNNSFQNIHEYADDNLEENIQEKTRKNILFAMHYGGGVEFTVKDIVNAIKNDYECYVLRAFKNKMKLYKVFNDYFISIKEFNIKYPWTPKMIHSDEYKQIYFYILINYNIDILEIDHLLLHTFDLQELAKKLDIPIILTLHDFYYICPSYFLLDENNKYCGGYCGDQPRNCSTRVTWIDLPANIVEWKNQWQEYMKELFGMCDYILTATDFTKDMFLEHYDSLKSDDITIIEHGRDLIRYDNNYTVPNIYQPIKILIPGVIGPHKGLDFIKELKGFDDDNRLEYHFIGQVDDELKSMGIYHGPYEREDFAKWVFKIKPSFIGIFSVCAETYSHTLTESICSGVPVLASNLGALKTRIESQGGGWLVNIDDAEETYEQILDISSKKEEYKFVTENLKDIRISSSEEMGSKYKEIYDKLTKKEDK

SEQ ID NO: 6683 - protein, 488 aa, Methanobrevibacter ruminantium
MNQKRDELNSKQNINLDSENEISSSEINLKKRDPQNKSDLIAQQRMKAKRELIERYNMSESEAESTLKSIENKVMQKKNKKITNEKEIEINSNKVRMDDKNCSLENSAGVSENKDKNDEAIKIQSQNSQIEGESEEIIPEHVLERQNPNKIDNSDYEINSVSDTLPVIEEGESKPIQNAEDEIVKKELVDSVSDVVPVVGEKEENNEPIIKKDDSSDVDDVLSSIIPEYHQKSSIEVNNVSLSFNIENDKIDNLKEYIIRTLKRTKEKKIKFHALNNITFKIYKGEKVGIIGYNGAGKSTLLNVITGIYEPDEGNVKTYGKISPLLSLGAGFDYNYSGRENIYLNGAVLGYDKKFLESKFDEIVEFSELQDFIDLPIKNYSSGMLAKLGFSIATIVEPDILIIDEVLGVGDVNFQKKSSNKIKSLMDGGTTVLLVSHSIVQIREICDKAIWIDKGELREFGEVNEVCDHYLKDAQNATKNQVKDIRFN

SEQ ID NO: 6684 - protein, 407 aa, Methanobrevibacter ruminantium
MKITVAGVGYVGLSIAILLAQKHDVTAITTTESKAEKLNQFISPIRDDEIERFFKETRDGKRKLNLHTTTDKESAYKNADLVIIAAPTNYDDVNHFFDTSAVEDAIEWTLKVNPDVLMVIKSTIPVGYSESVREKYGVKNIIFSPEFLRESKALYDMLHPSRIIVGCDDDQKEDAQMFVDLLLEGVRLEEKRSDSPKQDIPILIAPFTEVEASKLFQNTYLALRVSYFNELDTFAQTKGLNTNIIIDCVCMDPRIGGHYNNPSFGYGGYCLPKDTKQLLANCKDVPQALIEAIVNSNAVRKEFIADQIISNNPKTVGIYRLIMKSNSDNFRASAIQDVIKMIKAEGIKIIIYEPILDDGSEFLKSEVVNDLDIFKRESDIILANRFDQDILGDVADKVYTRDIFGRD

SEQ ID NO: 6685 - protein, 893 aa, Methanobrevibacter ruminantium
MEIRYKNLLKVFTIFLVLLISCGFASAVSDLDEGNSANIVDNGDLSLSDNMMSESADNCKNLETIEESHTFSEKNTVKDVSYGLSTPIDGNTFEDIQTAIDNAADGDIIELNGTYFGNGSDIKITKDLTISGNLETILDAKNKSGIFYVNSNNVTLQNLKFYNSIVPEYGSAVHFLSNGSVINCTFINNTAGGVYGTIDYFWSTGGVVYLAKGNGSVINCTFINNTANADGGAIYCGVDGGSVINCTFINNTAKELGGAIYIGGGHDGGAHYSNVYDCYVDNCVFINNTAGEGAGIYYGGGGLIFNCTFINNTARFGDSILVNNMYYPNTVSDMKTLTIKECDFKSNKEGWGYVVVNYKAYKNTICGLCEIIDSNFSNEQAEDYINIYNQGNIYLSGNKISSNYATISNDLIAYGNNANITSQTSLVILDNTTKSVEKYSPFDVYAVLVDDQGNYIRDENISLFIGSKNVTGVFDNVNLFKYHLNDLSSLNYRTLVSGNYDGAKDLVVKTGVLQLDVEVDIDLDYEDDNVIIKLKDSEGNPISGESVSLLIDNNTSSVKTDSNGEAKVPVNEISMVKAIFTDGFGVNVSSYLVVKAVEKVKLVPTFANAKISLDVEDNCSAVIVTLKDLSGNPISSAKLDALVNGAGKTLITNASGQAKIDIEGNATVEVTYIDAENANATVSSSLTVIKNVDSVPVIPNRTATNIICKDMNTTAVAKPDGRIGKYFEVTLVDVNGKALANKSVNIGFNGAVYNLTTNETGGAKLQINLGYEGKYTFAIAFLGDDNYTGSFKVALISVSKHSPKLSAPAKTYKANAKTKTITATFKTSNGNAISGKKISFNINGKTYSGTTNSKGVASVKISLNKKGTYSCTAKYAGDGMYKATSTKFNVKIV

SEQ ID NO: 6686 - protein, 1285 aa, Methanobrevibacter ruminantium
MAAYNSGAYIQETLDSLINQSLDFKENIQVIIVNDASSDNTESVCQEYIKNYPNNIILINNRINCGPAHTRNVGLHYAEGEIINFLDSDDYISKKTFERVDSFFEDFVHVDMASIPIKFVGSKRGDHPLNYKYKGTGVINLLNNPDAIQLSSASAFFRSDILKASLFNHSRSRYDGSVSVVYNDNSPVSDSIPMIFNENLSVSEDALLINQMLLRNPLLGILSNCTYFYRKKATDNTSLISDSANHRSYFTSRVNNYMIRLINDSLDLYGKVPEFIQYVVMYDLQWIMEIRQVDHLLDLEDLTHLYDKLISILFYIGDKVIFNQRSIPSILKSHILLLKYFGWGYLDDKTFNFKQIDKKYYDEHGNLIPYIEKDQLSFIIQKLELNKIYLDIVDIKNIKSKINLNNNNNGTPDDDKKDDGKNSHDFYLSSQDDEDRQELYLSGMITSFFNSDFDIYAIVSEKDKSSSHILEKEIKVKKISYPQRDNLSLNFNYGYNQCFEVRIPLSEKTSRISFRMGFKSLNEVCNSLGIETLSEDSFDYINHHDLAFSGDLLIDYNHTSRLSQVSNYKISKDYLILDNGNHMIVRKRSLLTTIKYELVTFASILGEREEGWRTGILLRALYFILYPFYRNKRIWIFMDLPYTADDNGLQLFKSVRNMDKLKLEDYNKLLDLDESLLSRERHPYKYELFEGKDIGLVGLIKNVFSSIKNVFSRDSDDDENGKVKFIKGGSLGLDDKYDELEDNGDYSDYLNEHFGFADVNEDYLDNQDIQVEGSSFEDDIEHSSKFRRNVYGKAGFVKSFDAKVDAKYNDSLNSLENRFDKRVSNIKTRTRNADVREKVGLSRDRDDNFSKGFSPIDFIYGFDLSKFLSENSFVYLVNYILYRISKLLLRPRKIKRIDNRKIKKYFTLEQSTSHFNNVRHMENQYIASSNRDKLRKLLAREKQSNEYNALKKIGPVLAYKSLKHRIYALYAEVIVSSHPDNNLIYPFYGNFPHVAGLVKAKTVFLQHGVTKDDVSFWLNRFDKNLDMIVTVSDLERDSFFPRFDGDGEYISSYYGYDKETVQVLGFPRFDYLESLEDKKEIVIMPTWRRQLHNLKKEEFVNTNFFRTFNALINDKVLLDYLDSHGYKLVFKPHPNLNKYIGLFDKDSRVEFDLNDLNFAENSKDGTAKYGSRRYADIFNHSSLIVTDFSSVSFDFAYLKKPIIYYHYDNDYHFDSENGYFNYESMGFGPVIKSHKELVMSIIGSIESGCTMDELYKGRVDKFFKYHDRDNSRRVYKAILEMDKYY

SEQ ID NO: 6687 - protein, 94 aa, Methanobrevibacter ruminantium
MAGTTNLVDAMLVLALGFLIFAVIGWNLQSVIFSDMDPQERQATMESINQITNVTQGEQLNSTPDTSNQSGEGYVEQGKVYKDSKTGNLIMVET

SEQ ID NO: 6688 - protein, 213 aa, Methanobrevibacter ruminantium
MTIPGGDFLTTGLNLISQSLLIPVVIILLVFVVVVVISLGGLIYEYTSRTKVSVDDVSNLILEISDSGSVDSMKSAIANSPIPKLQKDILLKIASTGNMSPNTREAFARKLIENEEGLTDKSLEITDIITRIGPTLGLMGTLIPLGTGLAALGSGDVNTLSESLIVAFDTTVVGIGSGALAYVISKLRNRWYEEYLSNLDVLSDAVLDFMAKH

SEQ ID NO: 6689 - protein, 293 aa, Methanobrevibacter ruminantium
MNQKLSNYFNMGLSLYLLLDLILITFTLVFKIENNLYYIIIAIDTILCVILIYEFYNRFKTAENKIHFSIRNSTEILAGIPIDLIFLPFAPNLTVFLTIFNLLKFLKIIGLFLEFFETIDVFLKKTHLDEILGLAILVILVSTLGIYLFDPSINSIFDSLWFVLSTITTVGYGDVLPNSYIGKVIGILILIFGVLIFSAITGAMTSYFARKVFATKDFNITENDDNIRLLKEDLSFNKKNLNNANEKIDKINNDVEKLKRELNEMKEELRESRQLNKELKEEIVILNENLKNK

SEQ ID NO: 6690 - protein, 119 aa, Methanobrevibacter ruminantium
MTMKTGSELKFNDDYEYMTFDLDQEFLLGELGQDEIRDKIITAQEILDNHLANPYEAGQEIEIENPFEKPILRKYIKVNEVTEDMIDIIYYQVRNHYEVYKFVTLTDPAHRGRILIPKD

SEQ ID NO: 6691 - protein, 157 aa, Methanobrevibacter ruminantium
MQFDELMEKGDQARKDRNYEEALDWYQKALKEDKRRSEAWNMKASTLGLLGRPDEAIEAFDKSLELDFNNEQTWFLKGMTLFAVDRFNEADSCFDKAVNSDPHNPVYWKYKGMVLSQLGHNHDALECLDNALELNPDDEAILVFRHTVVEAIEKEDN

SEQ ID NO: 6692 - protein, 651 aa, Methanobrevibacter ruminantium
MKEFKLKSPYKPLGDQPQAIESLSNGIKEGFHEQTLLGVTGSGKTYTMANIIQNVQKPTLIISHNKTLAAQLYEEFKVFFPDNAVEYFVSYYDYYQPEAYVPRTDTFIDKEASINEDIDIMRHSATQSLLSRDDVIVVSSVSCIYGIGSPEDYGEFAFSINVGDIYDRGDILRKLIFMQYERNDIAFERGQFRVRGDVIEINPVHGTPPIRIELFGDEIDAISLINPVTGMREESINRYVIFPAKHFVVGADRMDQALKDIEAELQSRLNELNLEGKYLEAQRLEQRTRFDLEMLREMGYCPGIENYSMHLSGRNWGDMPYSLLKYFPDDYLTIIDESHVTVPQIRGMYNGDRARKETLVNYGFRLPSAKENRPLRFDEFEASQNQVLYVSATPGPYELSRSKNVVEQIIRPTGLVDPKITIRPVKGQVEDLLGEVRRKVEHDQRILVTTLTKRMAEDLTDYYAKIGIKVRYLHSEIDTLERVEIIDDLRRGEFDVLVGVNLLREGLDLPEVGLVAILDADKEGFLRSETSLIQTIGRAARNVDGEVLMYVDEMTDSVRNAVDITNKRRKLQMAYNEKYNITPKTTQRTLKEKKLADRAPSRDDLRGMPKDELKLLIKDLEAEMREAANNLEFEKAASLRDQIVALKSIKK

SEQ ID NO: 6693 - protein, 638 aa, Methanobrevibacter ruminantium
MKFKNSHILLVSLISIFLLLSISAASAADSDIAADDSSVDIVEIEDINIKESHYLCDDASTGSEDLSGDENTSASGTDDATGGNDTDATGGDDTGNATSVNGTENVTDSNGTNATNGTNATNNTKYDGPVTNATIIPVSTSADYQYGNFTFKVVDNATGEPLANQKISVSGVYFFTFNNGSSISTTKVFTTNSNGLLVIANKNLNKNLDTLGMVYNFTALDVGKYDLTFSGNDSLKIVVNNTLPITVNKVNAEIKASNFKDEVGTSKKYTFKLVNKNTGTVIKLASLKFQIKLNSSGYTTYNSTTNLSGQVGYNLNLLAGTYPVRIVNNDSNLKASTVSRNVTLTKKVGVLSASNRTILYNSAPTAIIKLTDKKTGKAVAGAVLKVRVYTTSKKYSDLAFYTDNKGQVSFKAALSLGKHKMIISTLDNNYTASSITRYVTLKKTTGKISAPKISATYKSGKLYTITLKNAKNGNAMYGSTLNIRIFVTSKSYYKYTGMTDGNGKVNINTSSLKPGTYKVSVSSGDSGFTAKAATGQIKITKIPLKLSPTAYKEKYNSGKTFKIKVTNKNTNKIISGIKVTVKVYTSAKKYKTYTVKTTNKGIAYLKVTQKPGTYKTVVSLSNAYYSASAVTSKITVTK

SEQ ID NO: 6694 - protein, 230 aa, Methanobrevibacter ruminantium
MYSETKIAIPIFQKKKEDVISVAQDCIIKGADILELRIDGMENPNPKLVREIIEEINFPIIATNRTTREGGFFKGTDKDRIAILRECADVADFVDVELQTNRKLIESITETGVKTIISYHNFKQTPDLDFLIDIVNQEKELGDIAKIAVMPNNLEDTLTVLAILSHFDDTVAISMGELGSYTRVIASKFNAPFTFAVANDTTAPGQIDIDTMRVLLNSDLINTDEFENNE

SEQ ID NO: 6695 - protein, 241 aa, Methanobrevibacter ruminantium
MKVVAIGADISNNDVSVSKSLVENIEKDIPKLIDLGAKRAALTNVTGDDVVISAFCEDDLLETVNRGIADILRANAESLGDLAGVSDDPSKAGEGLSYAEASLNDDGYQDAIIMAFDTYGGEGFVKDVANSAIEAASGMKSVIDVSDRIGSRTDIPGVGYVSENDTDDPVVVVSVKDLEQIAVVAGAMIGAALGCKNTYLVKRHTPCNVLPGSVLVSVTAFMNGNMIDLSIPFENKTRILG

SEQ ID NO: 6696 - protein, 289 aa, Methanobrevibacter ruminantium
MIILDENVKCLVQGITGKQGSFHTEQMLKYNTKIVAGVTPGKGGQEILGVPVFDSIEEAKENTDVNASIIFVPAPFAKDAAFESIDHLDLVIIITRATFPIHDTMEIMAYAKAKGVTVIGPNTPGVISPKVGKLGIMPTHIFSEGTVGVISRSGTLTYEIASQLSRAEIGQSTCVGIGGDPVIGTPYIEVLQMFEDDPETTEIVLIGEIGGSAEEDAAAYIKENITKPVVAYIAGISAPPGKRMGHAGAIIAGNSGTAKSKMEALESAGVKVARKPSEIVEYIKEIRGE

SEQ ID NO: 6697 - protein, 400 aa, Methanobrevibacter ruminantium
MDKEEIINKLMAGEMKLYQIDKFTENATEALDIRREFIERHSNCELNQIANYTLDMEKAFSKNIENPIGTVQVPIGVVGPLKINGEHADDEFFVPLATSEGALLASVNRGCSAITASGGVNARVIGDKMTRAPVIKTDSVVEAVKVKSWFETKFDELKSIAESTTSHGKLVKIDPIIIVGNYVYPRFVYSTGDSMGMNMVTIATEKVLSKLYDDLGVHAIALSGNLCVDKKPAAINLVEGRGKTVVADILIPEEIVKSKLKTTAKAMEEVNIAKNLIGSAAAGSMAFNAHFANMIGAIFLATGQDEAHVVEGSLGITTAEDRDGDLYFAVSMPDLPIATIGGGTRLETASEGLSIIDCLGSGKVNKFAEIVISTVLAGELSLVGALAAGHLAKAHQELGR

SEQ ID NO: 6698 - protein, 134 aa, Methanobrevibacter ruminantium
MSDKEYIDFKKEFKDFAQDLENSKPIFDDEDLSFDDFDNLIGNIGENNLSDDSIDRYGSINDDLDKLDSLFGSDCPEITLETENMLMNLSIKKDYSKIKDFNLRKKEFFKDLKDFIDEFESTEESDELMKFYDD

SEQ ID NO: 6699 - protein, 51 aa, Methanobrevibacter ruminantium
MCSSGGPMADLSMKKLKTKKYKCLDCGNEFKGLGRKVICPSCQSDNVELRE

SEQ ID NO: 6700 - protein, 134 aa, Methanobrevibacter ruminantium
MVGIAKAGEDKMLFIGTPDNDEIVQYLEKDDLIAVSSFNLGKKYEKGIRSLIYLTRDIESPIIVLPKNHPASKRLKMVLSVGENVRLDCGIIPGTHPEQDILCSCDSLSGLNIVKSADGVIIEGNVPDYKIEPF

SEQ ID NO: 6701 - protein, 129 aa, Methanobrevibacter ruminantium
MEENEISPFFTIKKIREGDSIQLDQKYIKVRSNTDKVIAIHYKAPIERTIELEMFFEDYNPIERLNYNIGDTGWVGANFRGLIDGKDKSLPVDYDYKILLLEEYKCLSKVELKHVKRSSKFRPNYTIAK

SEQ ID NO: 6702 - protein, 172 aa, Methanobrevibacter ruminantium
MKVTVFHANECDKKKCTAFKMEKQGKCRIVYKIHQIPRGAVVLNPFSEKAVSFEDRGLVEDKGVVGLDCSWNKVSKSASFFSLSKYHRSLPFLIAANPVNFGKPCILSTNEAIAATFYITGFKEEANHIMDGFKWGHSFIELNYDLLEAYSSVKTSAEVVEIQNEFLAAHEK

SEQ ID NO: 6703 - protein, 53 aa, Methanobrevibacter ruminantium
MEDVEMARFEEAENRMFNVKICLKCNARNPAGATTCRKCGYKGLRFKAKEPRG

SEQ ID NO: 6704 - protein, 62 aa, Methanobrevibacter ruminantium
MLFLLFNYVFLYAILIIANLSFSIDLSTNSFSIYNHYLIFFNIPLFLLKKITLLKVFLNILK

SEQ ID NO: 6705 - protein, 249 aa, Methanobrevibacter ruminantium
MENVEQHLKEILKTRKIHLTLIDPDEQSPDEAVNIAKEAIAGGSDGIMVGGSTVDTAALDGTCKALSENIDNPIILFPGNINGASKYADAIFFMSYLNSNNPYWIIGAQALAAPAVNKTGIEKIPMGYVVAEPGGTVGWVGDAKLIPRNKPKIPAIYAMAAENLGMRFFYIEAGSGADQPIPPEMVAYTKRATSDIVLVVGGGIRDGIAAYTAAKAGADIVVTGTVVEETSDVKGKIQEIVAGVRKASE

SEQ ID NO: 6706 - protein, 361 aa, Methanobrevibacter ruminantium
MLNSLYTEAINKKGQLKEPLEELNESKIDLESKWNDTPIIPSKSNHIIAAGDGSYNKKKYLNFNFYAVAAESLIYNPTKEENKLSSIESVELDIMPHQSFLEDRLRNMMSIFEIKTAIKTFREYEIDYYLDDGSILGDLIRPIPLETISFEKKQEIIDSAYLKIKKGYENMDSDISSLNYKEEFKEFFDDEEIDEHDLIRLLENLENLIALKYLLENRKKIIAISKTSSSNELFYANIPDMAILDRFTRKEGFSKAYYRKVSYKVKHDFPIENEFFRNLGFTTVFARLKDYKNIIKIEFPYYIDDDEEIKNILSILKDNSTEGYPYLLKKAHKDVVISNQNMTSLSNVIGFLDKSGREMLD

SEQ ID NO: 6707 - protein, 502 aa, Methanobrevibacter ruminantium
MIGRCIGETSLIELSFISKEMPQVGEYVSIEYDGKVILGMIESMVRGSVSLNDDIYDPDTIEKIREIEGDDFYIKGKVTILGDINDNLRLPRTPAPPGTPIYRASSEILKDIFQMDNSLKLGHLISNEEVEIGVNINSMVSRHLAILAMTGAGKSNTVSVIIDGLLEYNGCMLIFDMHSEYVDAEFTNGEVNVIDPIINPQHMEFNEIKKLANIPSNAPLQERYFRRAFNEARKKVQEGVAKPTDFIEILEDVLVSMHESEQYESADKKKILDVMNKIEDLKVKYDKLLNTNVGDILKQLKPGMANVLDLGQVDENTAEVLVAHVLRRSLRSRKAYVKNKDKSALSYPIFFIVEEAHILAPQNRNPNSKYWITRIAREGRKFGLGLCLVSQSPKSVDAETLSQANNMIILRLVEPKDQRHVQTASENLSEDLVQQLPSLNIGEALVLGLMTKVPTLVKINEFKGRQRGGDLDIIEQWASQKKEKKETLQIELTRFNDLSGGY

SEQ ID NO: 6708 - protein, 463 aa, Methanobrevibacter ruminantium
MRFAHISDSHLGCRQFGLLEREKDFYEVFNRTIDKIIEEDVDFVIHSGDLFDSNRPSTEALLTFQQALLRLNEAKIPVYAIAGNHDSILRKGSLPPQVLFKDIGLNIISPEHPVHQLGAVLICGVPFATSSQKNALVENYNILSKVADTAVKSILVSHQGISKWMPEDSYEIDLDDLPKNFDYYAMGHLHNFYVEDYGKGKLVYPGSMEINRTSELNDNFKEFGKGFCIVDLSEDIPTVERVTIDLARKFYNEIIEYDKLDERLSVIEEELKTLEVKPIVDITVRGGDFESADVYEKINEKIGNDVLSFRPTFKPDNVLIGENQLDGDKTLDPKTLLKQTVDKKFAREEVTKLSVDLLDTLSEKRMGEAKYISDEFYDEYYYHKDENEVSSESEYGGSELNVNEHNDDGTSHLESSAYDSVSDNSSSLDDYLNKNLDSKEEVSDKEKSKENQVKTKEVSLDNF

SEQ ID NO: 6709 - protein, 932 aa, Methanobrevibacter ruminantium
MIFKHLQLKNFKSHADTELDLDLGISLIVGENGAGKSSIFEAISFALFKNYTTNNITDLVRTNKNLDEKIEMSVKLTFLCEGNEYMVERGGILSPSKTKSKPNFKSISNLFKISNGREDIIASGNKEVDRQIEELLNMNSSTFLNAIYIRQGEISALIDDTPANRKKLITKLLRIEELETAYNNIPSIIEEYKTRKAVLESNIRPESELNFELKKAKEDHFNLDDQIKKSKEEFEGLKVELENIKEEKEKLDKEKSDFESLKLKHAHEEENLSALNKGKEELFTKLNEITRNETEMGILKPFCEKLPIYKEFKESFLALNKLKEDEENHKKTLSQIEEYKTVIKDEQENHEKYIALEGEIKVLNNKKIEMSSEIKNLNELESRKDTLTQEVSLNNQKLETFFNSSKSVLSQFDLEEEISPIKTNDDFNKLESIVEDLRTNLRTSIDNTSTEIDNLKKESISLKQEIKSLDEPLADIKKVENKCPVCQSEISEDKKNELINGYEATISGNTKRINEINGFLLKLNEDKSLNESKLKSLDSIKNDIYANKHIVDDLDKSNKTLETLDAKIKELQGKKEELESLDKMIESKNGEFIELEAHNKKYLEASTLLKSFPDETKVKDDLYAIYGKIKTEDEKLKTYISSDSELSLNITLEELDESIEKLSEKDKRYNILLGSVKDKKEYEDKYENKKKEIESKTQEIEEIKKQIESSSYDEEYYNHVNILLERLNNKFTYYSQDIAVKETNLANFETVIKNIEEIIQQNREYKEEYIAVTEYYNLLEDFRKLYSKDGIQRDLKSQSRPLIQKNTKDFFDKFSFKYSDLILDDDYNISIFGPEGEANIDMVSGGEKIAIALALRLGITQAMSKGNIETILLDEPTIHLDSFRRQELINVLRSMSIIPQMIIVTHDTELETAADTLISVEKEEGISKIENS

SEQ ID NO: 6710 - protein, 141 aa, Methanobrevibacter ruminantium
MFEEDEKVNKIFNLIITQGIDSENEYKIFTERLYSKPDFLWTESFARDYAPFGEQFFSKVDIIVLLSGLYNDNKELFDTLIKKSEEFDIPLLLVRPYGMEIVPEELEEKVKSVVGWNANCIIDDIKSIIMGDYDFDDDFDI

SEQ ID NO: 6711 - protein, 357 aa, Methanobrevibacter ruminantium
MTSRRAEHERYLKSILSNSLSSGHPSKEAIERYRKSSPTYYNKLKLGLMNKYKDWDLLDIEGSSVIENIYGETLRIRRREKLDFHLEDKKDEIKNELSSNLKLIPGIGYQTESRLKENNYHTIYDLLQHDKYSHKAQKALNRIERNCFVSDFKLLKESSKYPMDHSQPIDKNRTLKALSSLDPFNLKFMDIETLGLSNVPIILIGIAEIKGKWIESNQYLLRDIEEEPAVIEAYLSHLDEASVHVTYNGASFDIPYIKNRAHYYRMDYNLDQIHYDLIYPARNLWKDVLPNCKLTTIEENLFGIKREDDVPGAFIPDYYQSYLKENNIGPLIPIIEHNRMDIVSLASFLMKIYEESF

SEQ ID NO: 6712 - protein, 102 aa, Methanobrevibacter ruminantium
MELTAEKRKELQEKVTTDINAILEKHELPYRMDGISVMKTSKGTSFLGNIRVHDPYKVKDVRKEVEDYFESYGNVTITSRDVVPCCELPYTYITFHIDYFNE

SEQ ID NO: 6713 - protein, 918 aa, Methanobrevibacter ruminantium
MSTESKDKQMGKIDQFKNDIRFRRKIEYVETIPGKDASYKKVDVLNKRILQYLEDKKIKLYRHQALAIEKTREDKNIIITTPTASGKTLAFNLPVLEELISDNDACALYIYPAKALSYDQLKVLRNFEDEMGLDLNPNPYDGDTPKAKRYKIRQESRIILTNPYQIHHILAWHHQWERFYSNLKYIIIDEAHYYKGIFGSNVAFLIRRLKRIAKFYGSEPKFILSSATLANPLELAEKLTGESFELIDEDSSPSGEKDFVLYNPYKSIKKDSKDQFDMDEYSRSVHMETERIFLYLILKDIQTLCFTSSRKIAELIALWTKRDMEKVKKRNVEKIAAYRAGYLAEDRRQIEDGLKSRDYLGVTSTNALELGINIGSLDAVIISGFPGSMISTWQQGGRSGRTNQKSLVILVAFENQLDQYFMKNPEFFFDKPHENVVIDLNNEKLLKNHIICAANELPLTLEEAKEEFNVTEDFLDNIVRNRDLRKSRGFYIYPYDDSPSFNFSLDQISNEIFTVMNGRTVIEHMEKSNMYREAHEGAVLINQGQTYIVNKVDLDSHFIFVKKKDVEAHTIALKRTNIKITKKIKKHRIGEFTVHFGELEVEEDYFKYKLMQYSKVIGEYIIDLPPLKFNTKGIWFTIPDSVKDKLEEIYKDETEVFAGGLHGTEHAMIGLFPLHVMCDRFDIGGLSTNYHEDTQEATIFIYDGYEGGIGICEKAIDLITELTKSTRNLIKNCECKDGCPSCIYSPKCGNDNKPLHKKATEYILDYMWDEMNKLSPEDLAKLEEERINTENSDYDNLNGHSDVEVEYDKKPNNAEIEIDDEREADNAEIEIEDDEAQEEYEKALEEFNKENYSIAKDILTDIIINYDNQSADAYYLIGKILFIQGDSMGALSFVKKALSIEPAHELANEFYFELKNSY

SEQ ID NO: 6714 - protein, 535 aa, Methanobrevibacter ruminantium
MISYEEFEKLVVEILERDISSNSDQKAAISADKSQSLFIVAGPGSGKTTVMVLKILKFIFVDDVQPKEILATTFTKKAASELLSRILSWGDKLKKKIPVFIMDKVMNGEMADGSVVDKVRKIDFNQINVGTIDSIADELLRVHRDAGTSQPILIEDFVANSVMINECLLKNDMYLHESLQEYLAEITGKESQIDQKPKVKNLTAMADILLSIKEHIYYNMVDINDILADTKDNERGKKIALNLIMEYEKTLRSQNIFDFAMLETEFLNRLSSGKLDSFLDDVKVILVDEYQDTNLLQESIYFRIAESAIKNGGNITVVGDDDQSLYRFRGASVDLFTNFIERVSRIGIEAKEINLKTNYRSTENIIDLCNDFVELDDEYQDARVKEKPKIVFPNLDSSEDTSENESPEDLPNEDEIETQKIPVLGMFRSSEEKLAMDLTNFLDELNRKGKVKRKVKRVLNKDINKKLNSDSEDALESYKKSGFELAQSEGEIIIELDEETGSIDDVAFLTYSPLRGSPLHKLLAKFPIFILKKTA

SEQ ID NO: 6715 - protein, 469 aa, Methanobrevibacter ruminantium
MKLSTRSKEYIIPEYSLTGDLLSFLTCNLQYRYQNKGNLPPSMPIQLWFGEFIHGVMEEAYLKWNNFSDEEKKDFKWDWERDIKPIEDIITKRLKVKGLNPPINYTENYGPKENMYSARVDRSIKIWGPHLFPLIEDAEVLIKGIRDMPKDNEGHSRSEYYSINGVIDVLSSVKLDEIYSIENDFNGDNEKSKNTFKQTTLDSFFVIDSCDIDNVRDKSSKKSGNKILEYLANNEEFKTILENLEDDEYEIIIDYKGMRRPSAPNKNDIDKNNIHLLNEDSNDENSLEDYKTWIQHEWQIVTYAWLRSMQEDAKPVICGIIFYLNELVPSTEDLLLIREDLENNKTDIPRQSIPKDWEILKNWDENGPKAIHDDLSKKFKMDRSIRIINIKEDLIDDSLLEFDEVVNQIESSMIRELNGSKIKEAWNANAEQRTCNACDFSTFCNKKDLEENTNENSNEEDNKPVFSVP

SEQ ID NO: 6716 - protein, 226 aa, Methanobrevibacter ruminantium
MDYDINENANYSKIFIDELKLSRLPVAVKFINDESEVPEGIEKIDESLRHCEMITKAAKGESFYSTAEEQRCAGGASAMGLIDLPPKIASGELYYNLGRFESIETAKSVLDNIYRKDERSFGIVYAPLEKANFAPDVVVVIANPKNGMRITQAIVYNSGEMFNAKFAGIQSLCADAVSGPYVSGKPNATLACSGSRAYAGIEDEEIAYGMHRDNIKPIIEAFANMK

SEQ ID NO: 6717 - protein, 246 aa, Methanobrevibacter ruminantium
MSNLKIISWNVNGIRTRIKNKDINPVLEKEPDIILFQETKASYEQMDKKFLNKNPYDYYFLKGESARTGGLASFTNIVPKIIKRFFIKSQDAFHRACVLDFEDFTLIHIYAPAGTGKKANFNQKLDYFNSLLKYVEKNKDKNLIIAGDFNIAHNDIDISNKDTKVSFTDEERSVLDKLESFGFVDALRLFNEEESFSYWKNKEENDGARLDYFFVSESLKDKVKSSSILVDVEGSKHLPIELEIEI

SEQ ID NO: 6718 - protein, 218 aa, Methanobrevibacter ruminantium
MLSVSAVITAAGKNSRMRQDQEKRNLPLQNKLTLPFKSKTVIETTIDNVLNTKGIEECAIVLGHYSSEILPLIKDIDDERIKIVMNNPIDVGLSVSLLNGLNNINSDIALCVTADQPTVSSTTFNNILDSILNSSNPNKTISVLRRLDIGKLDTAKGLGMPFAASRCELIDYIKDKDDNLNPILREIFADGFEFYGVEENHPDELININYYSDYESLL

SEQ ID NO: 6719 - protein, 409 aa, Methanobrevibacter ruminantium
MPRLFKKTSFKIFIALIVIIILLIPISMAMTSHHNTQNMAEISKYENGSTVFNGDNIIDKNKINKYPIVSDIGALTDQILRGDIADAFFSISTGVVPTPASELVTGNITKSGEIQGIKGPAYIDIEKDQINIVEPGNFLYGFNTPYTQAVIVEGGIDIINNKTNETIKHINANDITNDTLPGDMVSEETIKYWYNTSQVGSKYNIEFCIDGLNDNRSYITPTELKEKFPEAYNYSIKYPGGSPVILYKDNVNSTVVSSTYTYLGSHPQYNDANREYNARQFVTAWNGTVIPANTSGCGREGVYFSAVKEANAQSGMATHGVCPPARALRNAVLALGFSLPVGMDYGEDAVLFGYSPSTGIRVTNTLDYPIQINMWTEGAGTGMAIYADVVEYIPNNVTTTNSTETGTTI

SEQ ID NO: 6720 - protein, 443 aa, Methanobrevibacter ruminantium
MKAAIIGLGVEGKKALNSLLKHNWDVYASDLNVNIKMDNLPISLAQVNVSPSKDKITFQKDNLTIDLGFNNQEIINSADAVVLSPSIWGSRIAEHYKNSGKLLCDVKTKHRDIFTIGVTGTNGKTTTVSMIKEILENAGKNVLVGGNGGGGFEGYYDLILEADEEEYDVLLIEVCDMTVGFCRYCFDFDIIALTNMGNDHMDVHGSMEGYKDSLKEFFKDKTIFLNKNPEFPESFKEEFIGISKNTIEYGETDYEIDLFGRFNRLNAGLSQSLSEYINENVFEIDEEIIKTSLENFKPVKGRLELLKLNDCTIYIGKSDNSDAIKVILDEVDFTAIFIGTPRHNENHRLDILNEVVNANPDAIILFPGLEDTLDQAIYRLGLLNYDGRIEIANNLDEIVAFVAEFSHDPAIFIGGNGQETIIKIQDRLREIADSINESDYECD

SEQ ID NO: 6721 - protein, 367 aa, Methanobrevibacter ruminantium
MKGEMMTSDEKIKLVEELCMTPGISGFEEKIAEIIKRELKDVADKIEVDKMGNLIATKKGSSKKGPTVMLASHMDEIGLMVSYIDDNGYLKFATIGGINDQMLMNQTVVIHSKNGDVTGVIGSKPPHVTKPEEKKKVVPYDEMFIDIGAKDKEQAEEMVSIGDPITFKTWFEAFPNNLVMCKALDNRLGCYVMMEVLKRVDSKATVYGVGTTQEEVGLKGAKVTSYKLNPDMAFALDVTLSGDHPGIKPEEAPVVIGKGPAVILIDASGRGIITPKYIRELLINTGEKEEIPYQLEVSSGGTTDGTAIHLTKEGIPTGVLSVPTRYIHTTVSVASMDDVENTIQLIVAAINSLEINFKYIFSILNTF

SEQ ID NO: 6722 - protein, 386 aa, Methanobrevibacter ruminantium
MFGVKKMKYKSKFGFGCMRLPLKDENNPQSIDQEYFNEMVDTYMEKGFNYFDTSYAYHNGMSEIAIKKALVERYPRESFLICDKMPTWALTSEEDNEKFVNTMLERLGIDYFDVFFVHNINIPWLELAEEHNTFEYVKNMKEKGIAKKIGISFHENSDLLEKFLNKYAKDIDIVQLELNYLDWEDPAIEAHKCYDLCVEHGLDVYVMEPLKGGVIVNQPEEINNDFKELSQDASIASFAMRFCASLEHVKIVLSGMSKMEDLIDNINTFENFKPLSEEEFDFLLKEADKLRENLAVPCSECGYCLKACPLEIPIPEYFRLYNHHKVQKESNIYRLYFDKLADEKVPASDCTQCETCIDYCTQKINIPKELEKLCEHFQEGFSPYGN

SEQ ID NO: 6723 - protein, 2632 aa, Methanobrevibacter ruminantium
MKFRTPSKKDTNKDIEKEFKNLRKELLDLTLRNPLLNFKARNRNLSIINQSPINIYRTLVLENKKMFFQANKKETKKSKAHAFIDEAKEFLSQESDKTLKADLSPSELQKRLFYIDQQSKTMVQEQGYNILYIAIGFIEWIDNKKPRQKNLAPLILIPVEMERKKVGNSFSLSWTGEDLQNNISIQAKLREIGIELPKFEQTSYVEGVNHYLENVRQAIRPFPKWDVKYDIALGFFSFTKFVMYNDLNPESWDENIDLTKNELIQAIFNPSKNVYEDTFEEDDVDEKLHYKTMYQVLDADSSQIAAIENVKAGHNLVVEGPPGTGKSQTIVNLIAELIAEGKTVLFVSEKMAALEVVKSRLDSVGLGKFVLELHSHKTRRKKFLKNLQKATNVRSTRDLKLDQTLRKLENLRDQLDQYAEIIHRPMANVKLSPFELYGMKESSEDYFSRQNRLLPLVRFDNPEDITMKDLDDIIISLENLSELYSTISKNNPWSYCNPKSLLPADLREIEQLIMDTLEALTDFRYEMDIINEVYGIKVPNTLQEYEDSITALSLLNSETVNLIDSSILLNREWYSNPEQAQILIKLLASYQQSSNLFDKFTDYLLIADLDTLIQDLNKDLNKKFRLFGGNSHKDELSRLYKGPVPSEKEALNDLIKVRKEIKVRQSYNDNEKLGIRYFGDLWGKNANVQELKEVSIWMRKFTHLLSNGTFNENTVKMLSNEIFHPSIDDGIDEYIEKGNRFYESLKKLESKLNPRSKIIFKKESEDVPFDKWEIQLNKWKGQLSSLHLWSQYSNTKRACMNTHASIFIKTVEKRNIKKDDVKPLVLGNFADSLLNIVFSENEILAGFIGELHENRIADFKDLDRKIINLNRKRIFNKLNSQIPKIFGGANDPEAKILAGEFTRKSGHLPVRTLLEKAGGTIKKIKPVFMMSPLSIAQYLDPTNPKLQFDVVIFDEASQVKPEDALGAFMRGKTAVVMGDTQQLPPTSFFDQMTDSEGGEEVATALDMESILHLCKMSFPVKMLKWHYRSRHESLINISNREFYDNELLVYPSPCHNDPELGLKFHYNPNTAYHRGEGSANPLEAKDVVKEIFRHFEKYGDKKSLGVGTFSVAQKNAILEELEIERKSHPEFEPLFSDKREERFFVKNLETIQGDERDVILISVGYGYDTEGKMSLNFGPLNQDGGERRLNVLITRAREKCVVFTNFRAHDIHLTANPPFGVKSLQSFLEYAENLSQNQFIDQEEDEEAPFEDAIYNFLADNGYRVDKRIGCAGFRVDLAIIDEENPGKYLLGIQCDGHNYASSKVARDRDRLREQVLNGLGWKIYHIWSTDWYRNRDLARARLLEHIENTIITTKVNDLKSKIHDAESMQINPVTTVVIDKKNKEKDSDDDSDSDKTDKNKESLINNYLKDLEDEFGDNSDKKDNNNEDDDSNNDDGGLVIDSTDDSIDNPDDGGLVIDSTDDSIDNPDDEGLVIDSDTNLGSEEFDIGSDSVLDDDSDDEEFGVDSDSDLDEEEIIEDSEIKLSDTLNTDLKDEDIYEPEIELDDNSDSDLDEEEIIYEREIQLKEGSDLDTEDEIIIEENNNNGSDIDLDSDDVTVFELSDEDSSSDSDDVTVFELSDDDSSSDSDDEELDNDSNIDLEDEESDDNFTLDLEDQSNNLMPKSTIDKSEFLKDLYGEDDDLSSTIDEEPKILNDNNEVINKSFDSKDKKSSKNISKSELKNQEKAKSKTKSKTKSKAKPKNRNQEIKNIENGKIKNDDSKKEQNKPKSKNRSILNRLKNIGGGLGLSRSEESEGKEFIKAEDKKSKEFVSDAKKSIKRKDRKAKDKDSNDKKEINKKLNKEQNIKNNKDNIVESDKKQEEIKEEIQKPVPKSKPNNTKELINQNNKTIEELEEYINNSSNNSDLEFDGASDIDLEKEIISEDKTKLDVESDIQMDDEYVIVDDSELEDEFEFIEELDDDSELEDEFEFIEELDDDSELEDEEFEFIDDLDDDFGSEDEYELVDDSELEDEFELIDDLEEKSNNYDNEDINLKEDSEYLEKEESEDIMRQKESVSKRKVEHEIIDDSLDVIVPISAERRADEYNNYSEDANVIIPIQDEEEFEEEYYNNDSQVDSEEGIDELEELISENINYSDDDAREEFLTNKESNQESEEDSYYYSAVGIENSLKKNAVQYPKSSNRNKKGIVGAVSSLKDEMLYINASIKEIENPTEREKIYVIDPSEEEYYNQPDDSIYYNDSLSENKERYAKSKQYEDEVEVISPVSDSDEGETGHIQSDYIERKAEDSSKSSSESLFSPKKHEYLDKIKEYAAESEYEEAAENPTISPVHTEIEESVESSVISPVHTEYVETVESSAISPVQQEYDKTEEPSTISAEDQETEFIDDILLEEDELSNIQDTDDSALAEEEPESIEIDDDEFESIITDVDQDYQELEKERIKEANVLSAVDNTRLTPTGKLEDYIVAYKEIDDVIIKSATEIYDDEKKVATAVMDIVSAEGPIHVDMVIRRIRESCNLSRAGTKFKEAIFKAIDRNESHMNLIREEDFLFIDYDQIAVRKRDKPNIDLISDLEIENAIDLVLSFEKSLKVKELARIVSRTLGFKSTSKKTSAKILEVIDVMIGKEILVNVNDKIEFR

SEQ ID NO: 6724 - protein, 95 aa, Methanobrevibacter ruminantium
MSITLIHTRRRLAHKKTYKSPNERKKKTLARLSHKERAQRNRDKKRARLDRQKNKNKPKSRKPKKSKMPYRFKYYQFQDYKFNSELDQLEKIDSD

SEQ ID NO: 6725 - protein, 59 aa, Methanobrevibacter ruminantium
MFYSTIMKIDSIDRLRDIRDALLVEQGINPTRNGEQAIRVVVDRIDEIQSTLDKKIEKL

SEQ ID NO: 6726 - protein, 631 aa, Methanobrevibacter ruminantium
MGLFGFLKKDKKEKSNKKFDEESNKDLDEAIEESTDMIKKDSDSSKDKSESDDSKSKESKDSKEKESKSKEPNDSKSKKSKNKESKDSKEKEPKKSKSRLFRRSKKSEDSIDFDSIKHLSKEDMQEAKEKRLKKDSRTKEEKLKDETFRQIAMNHSNRNNRLAAVMEIKSQDILEDVCLDHKDRFVRTIAASRITDPNILEEIAYNAKYTDVRQIAFDQLGQVENVFAEIAKYDKKGKNRFAAINEIDDELILMDIVINAKDKKVRIKALEKINNAEILAEILKNTNDKKITNLIVEKESFDNEEVLSRIAEDESYDKFIRSEAIKKLNPDNEIIREIAINDSNEHVRLIAIEKLEDEDDLNEIALNSEYSSSRLQAVKKINNQEILSQIALNDEDKFVRMETLSKIDDEKILFEVYNKDSDEFVRSEAIKYINSPLNLADIAINDDNLIVSKNALNKIFSLYEEGDFEEDLDELLGKIAIKSNKDEISELSIKSIEKEDVLEHIVNESKNTNTLLLAVDKIKSEDILKNISESNENSKIRVKSVSKIKDKDNLEDIALNGNYNDARVEAIVNVHNQEILSNLALNDEDSKVREAACRNLNGLNTLKEVLAKDTDEYVRKIAKKRYDLISK

SEQ ID NO: 6727 - protein, 968 aa, Methanobrevibacter ruminantium
MMSSERKNIILKGGREHNLQNIDVSIPRDQFIVVTGLSGSGKSTLAFDTIYAEGQRRYVESLSAYARQFLGQMKKPEVDYIEGLSPAISIDQKTTKVNPRSTVGTITEIYDYLRLLYARIGIPHCPNCGKEVSHQTIGQITESIIEEGEGLKIHVLAPVIKDRKGEHKDILEDFRKNGFVRARIDGEIRGLDEEIELAKTFRHSIDLVVDRLVIREGTDFQRRLSDSVETACNFAEGIVTVMFNGRDSEGNETEYEKTYSEDFACTDCGISFQELTPRMFSFNAPQGACPECNGIGTKMEMNPDLIVPNKNLSLNEGAIVPWSKSNKKENYYYQMLQAVAEHFNFSMDTPFKDLSEEHQHILLYGSNEKVAFAFKRRNRSYRVNRKFEGVITRMERLYLETKSNYNRKYISKFMSDLKCPVCGGKRLRPEVLAVTVGDKSIIDVCDLSIKESYRFFQELELTERQMYIGKEILKEIKARLKFLVDVGLDYITMSRSSGTLSGGEAQRIRLATQIGSGLVGVLYILDEPSIGLHQRDNVKLIETLKHLRDIGNTLIVVEHDEETILSADYVIDIGPGAGEHGGKIIAEGSPEEIMESEESITGKYLSRREFIPIREDRRSGNGNFLTIKGARENNLKDIDVEIPLGLFTCITGVSGSGKSSLINQVLYKGLSTKINKKYMHPGKHDSIEGIENIDKIIRIDQTPIGRTPRSNPATYVGVFTPIRELFAETPEAKARGYKPGRFSFNVKGGRCESCFGDGIIQIEMHFLSDVYVPCEVCKGKRYNEETLDIRFKGKNIYEVLEMTVEEALEFFENIPRVARKLQTLYDVGLGYIKLGQPATTLSGGEAQRVKLAKELSKTSTGQTLYILDEPTTGLHFDDIKKLLNVLDRLTDAGNSVVVIEHNLDVIKTADYIIDLGPEGGDGGGEVIATGTPEEIAESGTYTGDFLKVVLNENRTALAKQLVEENSAK

SEQ ID NO: 6728 - protein, 530 aa, Methanobrevibacter ruminantium
MLWVDKYRPKTFKEVVGNNKQKKVIEDWLQSWQDGNPQKPLLLIGPAGTGKTTIAHIIANEFSEYIELNASDKRSQDVLMSTIGESATTKSLFGENKKLIIMDEVDGIHGTNDRGGTSALNKIIKNSKQPIVMMANDFYSNKLTTIKKNAQVIKMDKIRAPTINKFLRDVVLKNEGIEVDPDVLMKLSKRSSGDLRSAINTLQALVENGGELTEETLDTTGQKDNTATVIDTVTRVLKSTNAINVKRSLRENNEDPTLVMEYIAENIPREYEDNKEIKDAYEMISKADLFFGRARSSRNYGYWRYASDFMGPGVALSKKQTYKKFTRVTGPMAFTLMGRTRGQRALRDRIAAKMEEKMHVSLQVAYTIFPYFEIMFEDDVTAWQISDFLELEEDEIKRFRKKKIPKKVITAMEKVKAEMREEEKEEWRNSIKKGIFANVPSEADLADNNLNKNLIDEDYIEDITIKEDLNNISDDELDEIANEFSLKPSKSRLDKGKNDADNEEKKDKDEDKKEKTEEKLEKGQTTLFSF

SEQ ID NO: 6729 - protein, 314 aa, Methanobrevibacter ruminantium
MLGPWVEKYRPQTLDDIVGQKHIVESLKKYVDQGSMPNLMFTGPAGVGKTTSALALVKAILGDYWRQNFLELNASDARGIETVRTNIKNFCRLKPVGAPFRIIFLDEVDNMTKDAQHALRREMEMYTKTCSFILSCNYSSKIIDPIQSRCAIFRFAPIKAEEIADRLKYIAEAEGCEYEEKAIETIVLFGEGDMRKSVNMLQSAASTGNITEDHVYEVVTKARPQEIKEMVDAALRGKFMESRNILRDVMILQGTSGEDMVNQIYQDVAGRVMDGKMSGEVYMELIGAIADTDFRIREGANPRIQLEALLAKFL

SEQ ID NO: 6730 - protein, 493 aa, Methanobrevibacter ruminantium
MICPKCNTVNDDNEKFCKNCGLQLNTTRICPNCNTANKPNSKFCHKCGTTLSPVDTFKKGIIEENTSNSFFSTYKIPIICALVILLAIGAVTGVAIFGGDGNNGINSIIPLANDTYDDTNLNNYGVNHDNVSQTQSDNFTENQTDNLTDNQTVNQTVENKTKTATVQNQTDNNKTSNNDTNKTKVYSEKTNTTNSSAKVNTEKTNATNSSAKTYTEKTNTTNSSDKVYSEKTNSTNNSKVYTEKTNKTSDDNKKNDTSIDLKTDDNLTSIDSKINNTDDDNNSVIVIDNKQNDSDLNDSDDLNKNGLNDSDDLNKNDDLNDSDDLNNNSDSGKDTDNTLNDTTDDNKGDDTISDTIEMTDVPNLAQEAANNNYRFSSISYKGNVFTQAQCIDIFSEYILNVNNGVFSPIKINSVSSASSPSGEDQSQSISQSDYISIANRVHSWIDSNNQVPNYVGVSVKGQADLSPNKMLELFGQVVLNYAVTGDMPQSVDI

SEQ ID NO: 6731 - protein, 157 aa, Methanobrevibacter ruminantium
MKSIVFNIDCLLNFLKVRRSDLLERKFKRIIISNKVYNNLSNPSISQYIRDDLNTLIDKKFIKIEEINLNTAVFELYYEIINNYDNEILGESEASSIALAVKNKKTLAFNNPKSIEFYLEKYDIKCIGTKDILNDLLDKKIISTDEFYGILNELNQY

SEQ ID NO: 6732 - protein, 258 aa, Methanobrevibacter ruminantium
MRDRIKLNSFAVELRRDWELNPYSPIDLFSIVLSKLPDLTIIFYPMSENTSGMCIKNINLFNEKELEEECDSDDMVVCINSNMSKGRQRFTLAHELYHLLFEEDKEDIIICEDSNKDDSEIEANIFASYLIMPYEGLERYYKTNNIGKWTLEDTIRAEQFFQMSHHATLFRLKEQEFITKEECINFRKVFIGYEARINGFSDDLYVQSEESKKYYSLGKYIRSVEKAFSNKRISSGKRDELLLDAFRSDLTFNFNDGL

SEQ ID NO: 6733 - protein, 113 aa, Methanobrevibacter ruminantium
MKKIGQRLQGLRESKGLSQSDLANYLGISQPLLSQIEAGNRNLNLSLLDKLCALYGCTDSYILCKDDEYNAVNFSFRSKNAAREDLDCISSVHKIVLNMRFLNEIDEDDESEE

SEQ ID NO: 6734 - protein, 244 aa, Methanobrevibacter ruminantium
MAVPEINELFLPLLKTIKDKDEYKVKDITDEVIEIIEISEEDKNITLPNGETLIESRISTANTYLRKADLIESNRFLYYNITDEGLKVLEENPDELKEEDLMENSAFKELKDVYTHDDVTEEIPNPQDALKASLQKQMEDVRAEISNDVIKENEVKYFRPKNQKENDEIYEIRSRRANLKDDKDKSKRKCHDKHHGHKHHHKHKYIVYKEFSPADELLKYAELFERGYLTKEEFDKKKEELLKL

SEQ ID NO: 6735 - protein, 399 aa, Methanobrevibacter ruminantium
MSSKVDLEKAREYNKVKKYEESLSCYQSYLESGEELPEIDKERYAWDIYFARVKNASTIAELEEYVKELTKYAKQKNSSRREKPCSYTISILKLMKFYSDNITFNNNAYKLIAWADKLNPDYLSNNQAKRDDTHKYNSNKENWYLQITKGLFEIKKYDDVIRLSNEALEKIPEFNNFNDYWFKYKIAKSYKELGEYDKSLEYLDEIVKVKNDWFIYHEIAKNYYLKEDLDSSAKWAARAALSPDGKVESKLKLYLLIGDILKAKGYEDEYIMHKYLVYVIRNAKDWTQEEGWDEELASYELDLDNTDYKSIHKELSALWLSLKFIGQERQYGKITKVFENNNGFIKSGNKSYFFNAREFQDDKSFIYEGTEVSFFLEKAYNRKKDEVVDNAVNIYCEEF

SEQ ID NO: 6736 - protein, 398 aa, Methanobrevibacter ruminantium
MKFYNDTDIFVFLNEEYADFEGNEIESIESNIEDDFDYLFNFYEEKEEDYNHLVDFYDENLESFEFDSLIKDYEDYMNQIDSFIDDNQYREDNIESFIEDYEDEGEIFDLIIAKYEQERQEELDYYADEYKNQISPDDVEEKYYDHIESLDEMHYNNYEESIESKFEAYQSSPINNHIDYGNMHEVDNFSDYLDYKDMDTIDFALSQADSYNEIDRSPEWDIINSDGPEYDEPFFIEDFDDCDNIVVDYLENILPLDAELETLIEDDPYDSLENLISFDEEINSNIEGEIDFLISNKLEEMERYEYEVDSYLESLLEDKKAINNSIEAYLDREEYREYDEYYQFNDLELEEIENQGIDFDDLNNLDGTANIYFNRDEEDEEPFDLNEDIYYGDYQYDE

SEQ ID NO: 6737 - protein, 1546 aa, Methanobrevibacter ruminantium
METIAENQNTEFELNEYQEEAVTYYGEKPLLIEAGPGSGKTRVITERVRYLVEEKEMDPESFLIITFSNKAARELKERLMDYFDVDIINQMQISTVHSFCYKLLIENTNITYKILDDDYGTKKNMFIYKNRERLGFKRESTLTRGKVKDVVAAFDKYSTFDVDTEKLVEWIKENEPVSQDYIDFVNEEYRKTGKFPRKKIDLDKKKKNLKTATDYHAYADSWYNALHLQVAKAYPIYKKLLDEHNYLDFNILQVKALEYLKENPETQYTNILVDEFQDTDPVQIEIFEILMKNALNPIEKSKDDAEEDCPPISELELDEAEISDKKITSSFTAVGDMDQSIYGFRGALENYFEYFDNKYCCKKVGLNVNYRSTNEIIEFSEQYIKMQRGKKSRKNLREARKESRNIYYIENEEREMEAASIAKIIKGLKDEEKIKNYNDVAVLLRSVLTSSKDIINVFNDENIPFQVKGLQDLENKDEIKSILTLLHFIIEDDNPQETPIITFWEADWLNLRAFTNADFKQTFIKLSSETEEILIEKQKEFEENVFNYAKLIYNDITGNRFTKRSYKGVLELEDEVLDAVFKEYPKPVLTNKTLREYGITNEDDLEFFNQLNELKFEIFGDDKDFDERPTILNVYYRILEICGFLSEDYIFDPKNKQALDYIGLFTQIIYEYENIISNRDIRGLYWFLNSNIKNYSYDIENENGVNIMTIHKSKGLEFPVVILAGLNDSSFPREYEDLRETKYKNGSAVFYTPRECLRYKSLDKDDVTLHYEEEERNIYVAMTRAQDLLILSKNFKNPKKTTYSKTLEKEIKAIELKEKISSIKDELDELMKKEDVNDLSFLLKSLNDELKDIRAELKELKPLIKDHKKIKVLNKQLKELSIEIKWKIKDLKYEDKIMDDLIDLFNLDEDSGLTRDDLKNMFLNDFDIGENNEDSDESENSFEDIINDSTIDKELDNDNTSIDSLSSNNKPIEDYFEDKEALSDILVRTENEIAGLGEDIEKSLKRTKKLLSKLKELQDDDLNDSMSEIHFKYKMEIQSIIEGAIESNEDDSLSKNQIALNALYCMLQSIESEIMENKETMESNKEILKREKELNNKKSYLDYKIKLIKDTEEFDKKYDMGYSISSYEEYKIKEDLDELSKVLMDDSVNSIGDLALLREKVLEAGSPKLCEDFIINWELIESLFNDDKFAKLELLFKIMESEEIDNIRHMSILNDRTELKEKTKLFFMLFYYKNQEIEYKEKLSFINKKKDHLGNLINAYDGIIKIEPTEIDKVIDERKIPNVIVIEDDKKLTLSYSSIQTYESCPFQYHLAYNYKFKISDREAITEGNINHNSLEEINKTIIERKDEKEGELVGEIDNELLISRDEIIKIVKRIYMESPNIDRDETPIDYVLSNIFEYWDNYGRRFDIIGSEYQFDINREDYFVLIGSIDLLYKTDNGIVILDYKTTENISKKAQEKYKKQLYTYALALKDDPMYNDAVVDKLQIYAIKSLEMLDFELNEEERDEREEKIREIASNIRNEEFHSKGYDEFSECSFCRYSFICENN

SEQ ID NO: 6738 - protein, 402 aa, Methanobrevibacter ruminantium
MKYVIVIEDGASDYPIEEIDGKTPLKVAEKPALDRIAREGRTGLIQNVPESLPPGSDVANMSIFGYDPLLYYTGRGPLEAASMGVETKDGDVVFRCNTITERDGLMASSNAGHISSEEAAELMEYLNEYFNDKYPGFKGKFYPGVSYRHLFVYNDKENAEKLAKLDMVPPHDFVGETIADKIEFDSFADEVKSIMLESKEALENHPVNLKRIEEGKEPSNMVWFWGQGTMPAMPSMKEVYGLKGAVITGVDLIKGLGVCSGCTNLDVPGATAFFDTDYNAKGEYAIDALKDNDIVFVHIEAPDEAGHAKNLEEKVRGIENIDKHILAPLLEALPEYGDFKIAVLPDHPTPIDVGTHTRDMVPIAIYSTVDEPDDVQVYDEDSVKEGSLGELTGCNLLKLLLE

SEQ ID NO: 6739 - protein, 161 aa, Methanobrevibacter ruminantium
MRMNLILEILDVPGQLVSILGPIGELGANLVTIVHKREIRTEEGKVPVQIALEGERENLQAVVDKFKEMGVNLIEVDDTIKKEKLSTILYGHIIDTDLRDTVDKINAVEGLVVSDLQLKLDGELKSTALLTIELDLGKREIAYDKVMEIAKEKDFLVIDEV

SEQ ID NO: 6740 - protein, 71 aa, Methanobrevibacter ruminantium
MAIEKDAEKILEEFSKTLDQVPELEGTYYITDNLNLNREDESEEKDASKIVRNARTDKDGNVIVKRADWTG

SEQ ID NO: 6741 - protein, 603 aa, Methanobrevibacter ruminantium
MCGCIGLVGNFNKELLFSMMESTKHRGMDSSGYYLYNKGSSESLYENNFILDNRKSFNESSMEDNDSNQCSTIGLGHNLLSIFNLINEKREITDNINENRQPIILDNLVFIFNGEIYNFNKLESFLKENNENYVKSKSDSQLLANLIQYYYKETNSGNQENPLLESVKEVVGQLDGDYAFAIYDKDNDDLAISRDSIGVKPLFYAVTDNLKGFASERKALWKAGFEDSDIKDLKPGSILYNFEEIDLDDDLINEIINTDFKLLKSSFDDYKSYLDTKDTYDVYKELLADDIYEAVEKRVENIVDIGLIFSGGVDSTILAVILKSIAEKRQKQIDSVNNKSSDLDNVFLNGLGETSNPSNNSLENSKSSNDFSENVKPLNIRLYAVGLENSQDIEFSKRVAKDLDLDLKTIIIDEDTIRKSVPDVLTAIEDPNIMKLGVGMTIYLATKAIHEDNIKVALSGQGADELFGGYNRYLKHFDNHTLFDAYFDLDEEIYHDIANIYHVNLERDDAVAMANGVELRVPFLDKDVISLALDIPGKFKIKDGDDLLRKHILRDLAKDIGVAEYIADRPKKAAQYGSGINKILKKKVLRSFNIEEFVESLKH

SEQ ID NO: 6742 - protein, 88 aa, Methanobrevibacter ruminantium
MAKKNIYLAMILSFFIPGLGLAYDGVVKKFLGYFILGLIFIGLWFYFGMPLDAEISNTGFCCYLAYIIVWIFGLYDTLRTTIDINRGE

SEQ ID NO: 6743 - protein, 378 aa, Methanobrevibacter ruminantium
MAEFSLDVEEIKEEVEKSFQEEEKTIPNDKIKKQAEQNAIAIFEADFDDAAQREGIIKPLDDFGINAINRSSAKNSLLSTRFKEMSKGGSEADNVGDKLADLNRQVKALDPSKVDFTRTGFLGNLFHPVRKYFDRYEKAEVVIGNIIESLDNSSKVLQNDNTTLLSEETYLRELTKKLMTDIELAKEMDESIEVQIRNAEIQGVDQYKIDFVREEVLFPLRQRIMDMQQMIVVNQQGIVSLNVVRRNNKELIRGISRAKNVTVTALRTGVMVASALYNQKIAMDKIKVLNETTEDVIESTSKILREQGSQIQKTASETMISPEVLKTSFNEALAAIEDVSNYKQQALPKMQETIIAFNEMAQEGQKVIDKIEIGNNTQ

SEQ ID NO: 6744 - protein, 150 aa, Methanobrevibacter ruminantium
MTEEIKKKIKDMNFEGDFQSLDLYKEALFDLNQQFFSKKAKLSNLIEENYQYTNYNYDRLLNIVFHLEKMFNEEYKSILSIIQLSYKNNVVIDQLLQKKFKSLISIIDKTDSLYDDLVLNLSLSDSNENQRNISVLESMDSLIDSVKYYK

SEQ ID NO: 6745 - protein, 169 aa, Methanobrevibacter ruminantium
MKRYNHCIYCGYKLHSDDVFCPNCGVKIGYVDDQSVSLPLSKYKEQVLELRDEYEKKEKEVLSLVEKRFAPPQLTYHRFIGEIDNCRVLFFREAESILDIINLVTELSPKIETEIKKKIDLLKKIIDQMNDLINELIINMGDKEESENEVKIVLDDMKNLIDSVKDYDF

SEQ ID NO: 6746 - protein, 428 aa, Methanobrevibacter ruminantium
MTKKYGDRTLEVHAGQEEADPFTGARAAPIYQTSSYVFESAEYAANIFALKEPGNIYTRLNNPTNEVFEKRVAAIEGGVGALSQASGMAAITLAILNIAQCGDEIVSGNNLYGGTFNLFKNTLSKFGIKVNFVDSQDTKAFEDAINENTKALYCESIGNPKLDVPDFEVLADIAHRHGIPLMVDNTSAIGMVKPIEHGADIVVHSATKIIGGHGTSLGGTIVGFRVTFDWDQTASSPEFTEPDDSYHGLIYTEAFGNAAYITKARVQMMRDLGTCISPFNSFLLLQGLETMSLRVKQHTENALEVAKFLDNHELVSWVNYPGLEDNPNHEIAKKYLGDKFGCVLGFGIKGGIEEGKKFIESVELLSHLANICDAKTLVVHPASTTHSTLSPEEQIANGVTPDFIRMSVGIENVEDIIADIDQALKKSG

SEQ ID NO: 6747 - protein, 215 aa, Methanobrevibacter ruminantium
MTDNELKLETKCYDACEYGYLYGLNKKIPDEDWEKVKPYMRKWKRMDFVEGNIKVTGRPEGYRCLEEDVAKVEEILGITNTLAKRRANIEEKMSDPIKKVQFKDQCYNWLNMLFKSGTQPKQDLSRLAIHSTKIYDPADSFKNGAEDGYGELFIYTPHGMWYVINNGSDAANKSLNNLESKFGGAIGYRLMYADTVDTLIRVYTEENEYTGPQLY

SEQ ID NO: 6748 - protein, 744 aa, Methanobrevibacter ruminantium
MEDDNLEFNELLNDLEPHIFNFILDNLSEVPSDLSKKEQIEFITSNYSQDTIDDLIDEYNTFEIEATETLDSLEDDIFGLVAMGLDVPEDDKEEQISYIITNYSKDKIEYAIYEAELKREIIAELEELDDEYFNLIVCHFNLSDEIGERETLINCIFDNYSISQMKTAIEIADKKMVFYNDMLGFDDDVFSFICFNYSSLDYNNLKALENKESRKDKAYYLISNYSPTELHQKASEFFAKIDLFNSLDSLDEVLFRILIKNMNAYSFFLDRLDIIYNLMINYSDYIIYIEMDKARESFKTYDELRNLEDIKLLFLANYLNAPEEMIENWIKVSDFDNNIFKDYDVNPKNHIISFYIDDEEEEKEEEPKVKRNNLFGINYFDINPLELSPKEEIAYYIYKNKSEEDIIEGLNSFPNVIVDSDGNLVEGMNDSISNSNLNNPADSDINDIDDSDNKESDNISSNDDSTVKVNIEGADDGKSDEVEVKISDDEDSDSTENLDESDKDSNSSEDLEETQASQAPEKDSSRPEVSKEEFTKMLNELDGDVFKILTKKLAIVENNKVSIIDHIVSNYNYYEIEDRIKLISFKKDHYVRLDALDDATFNIFLKEFSTVPNSFNRFEKIDYIINNYSYGYIESRLEMVLDDIREIKRSLADDDVFFEIATYFKLPLHATKEEQIDHLLINYDLIRVRKRIAFYEGKLHVEGLIRGIVDKNKIECPYCGAKIRKDAKYCTNCGEKLSININID

SEQ ID NO: 6749 - protein, 248 aa, Methanobrevibacter ruminantium
MDLKDVYYSSKPYTQEEFESIIINAYKYVCEEIETKNKRFQACHDFEPCFICWNIELEGNEFTKWIEENSDLRVINKFNASMDVGVLGSFTEDTIKLENGIDLSKIPRCKGKCDREYFFNEECFFERRRLREKIGSIEDMELINPSSIFEFIDYKEEFIDLIIESVNLIKNHFPKAKIYLKYNWDHEYWDLTSICGNIYLKDGNNDENYSIYKYKLFPDFVKLRKSYGDFNYYIEMIDSDELDELLKN

SEQ ID NO: 6750 - protein, 264 aa, Methanobrevibacter ruminantium
MDIKTLQKRAIYYSESKYTRDEFESIIIGAFRYVCEEIIPNLSNFTRCGFDLNFERICFAKGVNGYLNKWIEENSDLRILRSTEISMDIGNPFSPKYDTYKLLDNIDYAKMPDCKLECPNNEDYEKIWRRKHCYWEREKVKERLNSIEGLILVNPNEIYRFVLKKDNFIDYIESTMDLIRKHFPMAVVILQFSPDPECETYDILSAVIYDADGDYDYSFLVQNEEFTEENWALIDYYDIHDLILKLTKSDEYYKSLIEKNLESE

SEQ ID NO: 6751 - protein, 148 aa, Methanobrevibacter ruminantium
MYKLKNFLKGHFAKSKVEDLNFHCKINENFLLINPNEIYDFIGENNSLIELINISFTLIKKYFPDSTIYLEFNQDPEYEGLNSIFANIYDGTNSYDCNMDLFEDLSLEFRELKKQYGKMDYFLDMVSVDEPFRNRLNDKFDGFLKIVR

SEQ ID NO: 6752 - protein, 119 aa, Methanobrevibacter ruminantium
MSFDWERFIDVAEHLRNYSNREEYQRTAVGRYYYTCFLIARDIYYDMAKVPEGTFVSHESVITFFEKSKKDIEKDLGTKLRNLRRRRNNADYDKEFRFADLNDIKKRYKDIITLLDKLK

SEQ ID NO: 6753 - protein, 143 aa, Methanobrevibacter ruminantium
MNNKTRMVVGRHSKRTGPEMDQIVEKYYFFEEGFAGLMMLFEEDWFVDKLLELKDLVLEHYDDVVFYFFNLTLKSDLESCCFLVTVIVKKDDGHEMSKSHIRSLISDRINDGSKLPFMINLVEVSDPLEFKRYTQGEIGPHKD

SEQ ID NO: 6754 - protein, 133 aa, Methanobrevibacter ruminantium
MQVAIAKKENGEILELDDISYQFVLWLNENNLTQLDPIYAKSVLKTTVGEFSKLTSQHEFEGEDEMLVPQLNYFVELSTWASWKDGKLMDEDEEITISFEICDVVFNRETMKEEYHPIEMTYMKSFIESFLEK

SEQ ID NO: 6755 - protein, 611 aa, Methanobrevibacter ruminantium
MTLTAEQQRIADDMCRELAPITFIQGKAGSGKTHLINELINLLEIDEILCPTNLAKQLYGRNARTIHSFFFHEFDKIEEGYQNPKAYDGVRNDYFLRNIAFTKIIVIDEVSMVRSDLMEMIHKILSTALKNDSPFGGIKMILVGDMFQLPPIVESEETYEYLKNEYGGLYFFDSHVIRNNLSQIKFYELNESVRHKDDSDWVNMLDMLREVPKFERVLPILEKINTRVVSPDEIPENITAITPSNAEANRINRRQLDKISGEEFSSRAHFRIKELDSKDYLEFYYSEDPMKIDMQKYYPIEVPSRFEAFLRYKIGARVMLTGSVMGGGKNGDFGTIVDREIIRDYDDSITEIIKVKLEKNNQVVSVTLDAFSAVDYKYEMEYDPTSHSLRRKTPYIQRVKQYPLKLGYAFTIHKSQGQSFPEMVLDLKSNIFASGQLYVALSRVKKLEGLYLTKPIAFSDIIIDERIIQFLDSLRNREFDVPEDGSSIGSQEVLISKKTPLNDLFEDFLHETESQAENEVNRTIHRLVDYAYALYQVDEYDMILLEIKKIAQIISNQFLIPQEDMEFIEKVKTMSDDKIDESICTSVLFNLYDVYKRVHDDPNPIVVDKIH

SEQ ID NO: 6756 - protein, 566 aa, Methanobrevibacter ruminantium
MLINIKIKNFRSLKDFEMNFNPGLNVIIGENDAGKTSLIDSLKILFGLKKIDINDYNEVGCPITIALDESNFHYCLESRIVEDTVVNTFYLKPTEDKINEMKTRLNGMDELKEAEARKMLKEYCSIFDISYRSNSIMENLKSKILESMESDEYTKVKSFSYPISFLGSREFENIDSFFENTFFKELKEEIWNIHIGDKTLNQHIDDYIEEFKNEQLSNQDAEELNAQLKEFMPDFKEINPIVNPSAKLSLDVDVEILNSSGQRIMIEKMGDGTNRRTTMAIFKHKKDKKDLVYVFDEIETHLHIKAQLDILKLLKDLTKENKQIIITTHSPFLINQVNLNEIHLMSIDKETGSKVSTLNSSEESQVALSNLGINNIDLFFTNKLLIVEGESEQNFIPIMYEKIYGYPISQNFIKIVKADGIRDIPNFIRVIKKSFSKTDIFVLMDNDADELTEERIEKMVEGDLIHRDNIFEIGDVEFEDTFSDDILRQALSQYMSDTLGYAVEASMRDIQNARHSDKFSKVLGEAFNRRTYKNFKKPLFAQYLAMFAEKEDIDEKIIKLFELISD

SEQ ID NO: 6757 - protein, 241 aa, Methanobrevibacter ruminantium
MYLEMNELACACRRQWKIDVNESIDIFSLAINKIKNLTIVFKVMDNDISGACLRLDKENIIFVNSRHSKGRQAFTIAHALYHLKYDENNFNICGIDSDDETEQKADLFASCLLMPHGALETYKLNNNIQKWDLDSIIDAEQYFQISHQALLWRLRHFLNEITYEQYRAFKEDINRNASIRGYDSSLYAPYLNKDYLTIGNYIQLTEKAFENELISLGKKEELLLDAFREDIVYNLNEEIIL

SEQ ID NO: 6758 - protein, 115 aa, Methanobrevibacter ruminantium
MGFKNMVETVGDRLKRIRLEHDFTQNQIAEYLGFKQGQIAKLESNKRILRSDSIIKLSNLYRCSPEYIILGIGEYSKTNMAFRSNNKNLSLDDIAEMNRIINNLEFLSRITDKQE

SEQ ID NO: 6759 - protein, 373 aa, Methanobrevibacter ruminantium
MIIQEIFYDCEKFLTIVHNGMDNDIKKRVIQKSIDVSRHEILLKERYIEKYQLENDNYEFFIKGFLDCENEKNPYTNYSTYFKQYVYPNKNDEIDNLSFKDFKKVYDFIYEYTNFKFTKLNINNIFLFFPTDILVKSIKSETTSYLIIKSSENISNISVKFKLNDIIKESINLTEIPNDNKIKSRENWNNYEIEIFDKDKIIYKSHTYVIMSINFNMGITTKIKKIKLNKFDKMVNSSNLKTEKFTISEENGLINISNYLLEESKNRNELNDVTKTECIFLRKNEREKAYEILEKLVKNDGELFIFDPYFLKQSEGKDVLKDLLNTILTHNDLVNIIFSKDIGESFENFKNSLTVDEKLFFKNIGGSAKKLFF

SEQ ID NO: 6760 - protein, 498 aa, Methanobrevibacter ruminantium; identical to SEQ ID NO: 5951

SEQ ID NO: 6761 - protein, 380 aa, Methanobrevibacter ruminantium
MNFYDLNKIRIKIAEDEIDIKENDFLYELYDLDNFDSLFDELDILINKIEYHQFEFTLIWYVGFFNIIKYEDIGNLPNISKLKSYNYLKGGLIKYFRGHFHLTNYTMEIKPYRNYYSFIEHYVLRPFQYRAITKLLNWIYIYDKKFFFELHYFDKSNFHFLRLFKLHEIKNFELEEKYIDFNCEDELKNYILFNYIITEYIHSVDKNLPKDIKTKIESDFKLIEKIEVNILIKIILDYIRFDETKKIPCYFLETIEENEETFFTIFESLEIYNINELNSLVNPLKEIHINQDRLFQQMITKLEKLLTEEIITIDNYEWEHFLNIIPEKYVLMINGLLRKTIGDLTFISELDREIRSKRYFSEKNKEKKLKELIDIAKNIN

SEQ ID NO: 6762 - protein, 456 aa, Methanobrevibacter ruminantium
MQTCSYCGNKIRNKAKYCDNCNSYLKLNNLEIQFDPKKYEKIRLLEKAIKEASNLIEEDNYGNLSAKTQIQIIYDTIYSYLVETTNFLKVLKKYDLNEKYFVYHSLEFINRVSKYPNGIISNEFLFEINRIFSDLKNKNNNNTRKYLFYTNINNREYIENTLLEILEYFDFKVFSYDDFKFPPEFPENFKTKFKSKYLILEYNSAENHISNKEEKALNQLYLLFGYLTFIHRFGRLNEKWHVNRFTLNHQISDLNASAMIELDKNNNFLDIHESLDILRTEIKLDKSDLIKFTNIPFKTNLYESIKNDVKNEVVLHNIEEYLRLYYIASTKSDLENSFIKFWTLAEKILKATFGQMNDESMVRYMKKILKYFGFANYIQDRIPFLRIKRNRLVHEIKDEITINDRNIIKLVVDYLILFLLNWSGELNNNEEYKFILDNFNKTDLNRRVELLSILNE

SEQ ID NO: 6763 - protein, 903 aa, Methanobrevibacter ruminantium
MVLSQSEMRRRAEKFIETYKEVSDERSYSQMFWRDFFDIFGISLNDVAVFEQAVKKFDGTQGFIDCFWKGKLVIEHKSEGKNLNSAFQQALGYLDTLSSLEKPRYIIVSDFKRIRLIDLFEDKKTEISLFDLKDNIQMFNFIYLDGVKHHEKQEELNIEAAELMGKLHDSLKESGYVGHELELLLIRLLFCVYAEDTGIFNTYQFFDYIGDEEDPISVGPKIQQLFRILNQPESQRQTNLPEELANFPYVNGKLFEEPIVPPYFDYEMYNQLKEICKFDWSTISPAIFGSIFQSIMNEDERRQLGAHYTSESNILKVINSLFMNDLWEEFRKAKKNSKKLEQLRDKMGKLKFFDPACGCGNFLIIAYRELRLLEYEILNILHNIKSERDTQVLFDSKELSNIKIENFYGIEIEEFPSLIAKVAMWFIEHQMDLKYEQLNIHKSNLPLISSANIIQGNALKIDWTQFLQPTNEVFVLGNPPFVGSREQTKEQKKEMKEVFKGVKRNGLLDYVSAWYLKAAQYIQNTNIKVCFVSTNSICQGDQVGILWEVLMKKYDIHINFAHQYFKWSNEARNAAKVYVVIIGFSTVDISPKHIYTYETLDSKPDLEIATQINQYLIDSEIVFIKSRNNPISNVSNIMKKGSKAYDYGNLTLSLEEKNELLDEFPEMEKWIKTFLNARDFLKSTERYCLWFADITPCELQQLPAPIKLRINNVKEKRENSSDSGINNIVNVPWLFENNQPKNDFLAIPVVSGEKRDYIPMKFLSKEIIVTNAIYTFESATLLDFAFLTSKMHMAWMKYVCGRLKGDYRYSKKIVYNNFPFPNELSEKDKNNIIKKAQKILDIRDEYKNESLEVLYGEYMPNSLQKAHIELDKAIDKAYSSKKFKDDNDRMKFLFNLYLEYTSD

SEQ ID NO: 6764 - protein, 305 aa, Methanobrevibacter ruminantium
MSKFYEAKSILKNLEVPDKQQSDICVYTFLSLLSVSEDTKWEDSTNEWIRIHDVIQFIKNNYGVVYAENSRETIRKTAMHPFRDAAFIEDNGVPTNSPRYKYRITDELLEVVISYNTSNWGSALSSFKENHETLIEIYSSKKEMRKMPVKINGQDLTFSPGKHNILQILIIKEFAPRFAPNSECLYVGDTTKKDLIKNTEKLQELGFEISLHDKMPDVVLYSEENDWIYFVEAVTSVGPMSQKRVNEIEKMTEEVESGKIFVTAFLDMKDFKKFSEEIAWETEIWVASFPDHMIHMNGDKFLGPR

SEQ ID NO: 6765 - protein, 490 aa, Methanobrevibacter ruminantium
MLNYVSNETNSFLNSISKEERKKIGQFFTDVDVAKFMAQLYVPTKKHLDILDPGAGSGILSAAIISQLENTDVDSINLTLYENDSRILPLLQNNLKFISENTSINLKYEIIEENYILNNSFSIESQEFCKKEYDFVIANPPYFKISRKAPEAQLMESICYGAPNIYFLFMAMSLHHLSKDSEMVFIVPRSWTSGAYFKKFREYLLSAGKINQVHLFVSRDNVFNKQNVLQETIIIHVIKSKKPLESIKISSSSNNDFSDIDEFEVPYDLAISNDENHFVYLPTNKGEVKVLNDVHKFDSSFLTEEIKLRTGLTVDFRNKSYLEEKPNKDNVPLIYPFHFNKNFITFPVEHDKKQYVNMAKKGLIQENKDYLFLKRFTSKEEKRRLQPAIYLKEDFPNYDYISTENKINFIESTNDDDLSKEQIYGLFVIFNSTMYDKYYRILNGSTQVNANEINSLNIPSRTSLENLGRILINKNDYSVESCDEILESIL

SEQ ID NO: 6766 - protein, 775 aa, Methanobrevibacter ruminantium
MIDRIDIGTVLGNEFIVIDKYGGEGKSGFGTVFIVYDDDLKKALALKTLQDKYLNDEETIGDFKKESLIWTELKHPNIVEALGLDIIDGRLFIIMEPIFSFMGKQSLDDYFFEGLSDYKILDWAIQFCYAMEYMEEQGIKYHGDIKPQNILVWDNEIKITDFGLTSFINESKIFKNKNVGNYYISNGKLCGTNAYMAPESFEGINNISTDIYSFGIVLYQMINKGNLPFEAENNFDNEWEELHKKAEIPYFDHILYDVVLKCLSKNPKDRYDSFKDLKRELISIFKETFDEEPYVPKEKDFEKDSNYYYFKGNSLANVGDIENFISNYDKAIELNPNSSDIRINYAINLIKYGYYDEALNHLNLAKKIFDENNKNFVSLDRLYFNFGHAYQSKGYLNKAIENYENAIEINENYLESYVNLGNIYKELELYEKALEKYQLALDINPNFFMALINMGEAYSFLGNYEDSENCFYKAKYQNINEDLYSLWGESLRRLNREPYALTKFFEILKINDESMYAYYNITISYLILDNLDQAKEYFGKALDLFGDNITYKLDLSKQFFKYGFQEESLEILDEIIETSEDNNKFFALFQKFNIFKDSDVKYSTSILDEIIYSSADDELKSEAYCDKALFLKDYEDFDLILEYFNEGLSLNPYNIRIYYLKGCFCHENEEYELAMQTFEEGLFIDKYNKELLYEKSRLHLLFGECEKCIGCCEKYLEIGYPSAEIYLSKALGFMGLEDYNESLNFLELAQSLVIDEETKEMILVTKVTIENFLER

SEQ ID NO: 6767 - protein, 458 aa, Methanobrevibacter ruminantium
MYQVSEKESSVYKYKALGTSNDREIKSKDVNDHYKVTEYNIDLIYNEIKEFIHYYLFSGEISTDFTIKVQDLFEMDDDDLRTLKTVHFLLSDEVRDLIQILPYLLRNLSHSTQKEKEEFNGIVRGRIDWNATLKTRYAKGFNDPSLFVCSPPSKFYDLEENQLLKFVLRKIISLKNNYLDFVDFIRNDEENPFDIESLSDERDWYEIVGNNYKMAKKTLKKVYFDDISDVRIIKAKHIRKAFKNRNVLYHRVARAYILYEDLFINEDIELLKELVEHRLIKATNPNKLYEIYIFYSLVRALPSPELRLLHSGNDYSTFDVLEDGTKVTVHYQYLPKPLQEVSEYAEILRNYNIQWAYRAPDIILEFEKEGKITYRIVEVKNSSSANYVRDSVYKVMGYYKDFERILYNEEATFTENCPIVLVTWGGIRIKDNYDPFKDSLIVLNRNEFLDSLEKLINL

SEQ ID NO: 6768 - protein, 952 aa, Methanobrevibacter ruminantium
MPNIEKYAYILDDFKEILDIYPIESKKPYKNNEFAAKMRNDIADDFNKFILDMVSNKEKYHSKISPGMMDWSKKPWAGFYHKDVTNTFKFGFYLIYLFEGDGSGFTLSLGQGVDDAEKKLVKRSEYLNYMITENELKIPDGFKHEANVGESIIRKFYKKEELDLEEFCNDLEKMIKIYESLIPHYNELRAGEEPSRKDVRPKNSGSKVWRISPGGSDIYDEAWEEFKQESYIGVGFYHGEIDYSTFKNKWSLDRYLDKDGVKDPSKAMLWKFVNWVEKGDIIVANKGKSKLAGIGVVTGDFIPLTKNKNRNKFGLDNIYPVKWIYTPDDLEISKNFFARHTLVEWQGDKWNQLLCVLARNDEVLKERILKKIYDESYKLLFEREDYHHMEGYKTESKEINDVWNDLLLKYENDEDIVDDVWDRLVNRKMKVHGDGSKNIKASIKGKLKISDEDLSKTAILLFETLKGLIGNRDEADQKRIIKEFNDSGYSKGFKSGRFSSILYYLDDYYYVINQKTIDTVKLLSLILGDEILLSNELDRYISNNAKYKEFIHNLRNAYYYDKYDVFEFRAFDAICHYLCSTPPIYFATNKAEKIPIEFYVDTDEILEGIDESEFDEMDLDDEEIEEITEVYIEETKYELLNINPPLLESKLQSFAIAETTVNQLCASLNAGKNIILDGTPGTGKTELAIKFATAASDNNFIDGYILTTATSDWSTFDTIGGLMPNEKGELFFYPGKFLDAIAENKWLIIDEINRADIDKAFGQLFTVLSKQDVELPYKENGKPIKIKLWDENYSKHDKEKSTYYIGNNWRIIGTMNVDDKDSLFDLSYAFMRRFMFIEVDLPEETQYKRLIKMWSNDLSEEYTNNLLRVYDVIKFRKLGPAIFKDMTEYIKFRDEISDDSTDLILAEAISSYIVPQFEGLNRNKVEQIRKLMGDIGLSQYLDEELKELIPKF

SEQ ID NO: 6769 - protein, 46 aa, Methanobrevibacter ruminantium
MEDELLKKYFNELRKEANNEDFINELEGSIETISREEIVELIKKHY

SEQ ID NO: 6770 - protein, 117 aa, Methanobrevibacter ruminantium
MGQKFNIKELEIRSFRGIKDLKYDFEGKSLVLCGPNGCGKSSITQAFEYLFTGQVASLKGIQGVKHDESLIHKGDSKEDLLVKAKIGGQYIERSFNEEFNPGRLKDIYEDSRMALFY

SEQ ID NO: 6771 - protein, 629 aa, Methanobrevibacter ruminantium
MNRKKLLSFIESKPRERYNQITGLISYEKYDEIETKLRQASKDINDEIKILNKRNDEKISELTQFYSCESDDLYEKINASLKKNNLKQIDENTNLTQYIDENKLSKPHKLLNKNIEELNHDYLRLLDNYENITLTELKTTNSLVSLLEKSREYLLLENPDKCPICQKYIDSEEIINDLSPKIDKINENLKLFKDWKNDCNIIIKQLSDLDYEIKDFNGENHNSLDYDLNDLIESLNDLSNFDKGLSEMDREILGSLNKDIISIKGKMQANTDEINRNLDHLQILKNIRENEKYLEKIQKQYDVSKKSHELFKKIKEEELANILKQIEEYTIEFYNYIHYDEDINSPKMKIKGSNSLTLALFFEDDESEPRSFSSEGHIDTLGLCLFLAFVKEFNKYDFIILDDIISTVDLEHKEQVINLLFEYFGNYKFIITTHNKLWFEQLARLADYYQQGRFQFVEITDWDREIGPSLSRKKDEKERIEQYINDNDTFAAGNAIRRQLEYELDKICKVNEIPLPLKKHYTVGDYYTPTKKFAKEMFKDTDVEEYYKNVFKELDLSLYKANLTSHNNEMNYDLNINEIKKLRDAVYGLETAFKCKNHSGNYVLKFDMDKCLGLCSHKRCIDFFTFNRI

SEQ ID NO: 6772 - protein, 334 aa, Methanobrevibacter ruminantium
MKLVVDGFGKSVAKRDNQIVIKENGKEINYYLAKDISQILLTGKGSITFDALTLLAENDVDCVSINWKGHVDYRLSAPDRKNAIVKKEQYFALTDSRSGYLAKAFVRAKIENQKAVLGTLAKSREEKDYIIEQREKVSEHIGKIEKLSNINSDNIRNNILGIEGQASHEYWSAFASVLDEKWEFFGRSGRGAKDPVNSLLNYGYAVIESEIWKSIYLAGLDPYCGFLHSERYGRASLVYDLIEEFRQQIVDKTVLSIVNRNQITPDDFEEDGNYIKIHERARRLLIAKILDKLNSKIMFHSKNISYSDIILYQGKLMADYLTNGVPYEGFSLRW

SEQ ID NO: 6773 - protein, 41 aa, Methanobrevibacter ruminantium
MIERYIISGDDEISYCSQCRNYETCDGDDCDPYFDDDLYDL

SEQ ID NO: 6774 - protein, 92 aa, Methanobrevibacter ruminantium
MLVFVMYDIVDTPTRTSLVKKLKHYGLHRIQKSIFCGFLSIDERLNLASEFDFFMSSERDSIILIPTCESCVDSILIEGNLDLPKKSLYEFL

SEQ ID NO: 6775 - protein, 254 aa, Methanobrevibacter ruminantium
MWVKRIYYVSLIRFKILKKRLIKSLLFRCTMKINTCHLVLKTNKKVKQNPSKFRGYIGREFDKYPILHNHYGNNKFLYSYPLVQYQIIDGQPSILGIEEGADILVDISSKIKALKMGDSYYRVEDHYLYYKEYDVRATRKYHQYKFLSPWLALNTKNYQSFKNIKDWKEKKSFLNNIMVGNILSMSKGLGIIVNKRLHVSSLLDDEIAEYKNVQMNAFTGEFKVNFNIPDFFGFGKGVSQGFGTVIKVTDQEED

SEQ ID NO: 6776 - protein, 455 aa, Methanobrevibacter ruminantium
MSKKEQILILSLGGSPEPLIYSIKEFKPDKVVFLCSPQTLKECDGILEETAFNEENVEIYEIPDAESLDDSFSTSKKVLSKFADDGFEVRVDFTGGTKPMVSGLVLAVIEGNYSNFKFSYVGQKDSQSRTKNGVGVVKDGSEITKMQINPYKKYAITEFKRGKNFFNTYQFEAALENFQSAKSRFIKGTEQRRISEIYERIVILYQKWDLFEDKVSKNTDLFKYLGFIINDIEKDEFILNEFENIDFFIQMKRNYEFLSFKIRGVSYDSEDPSIKGHLKFRISYYLSDLFNNAYRRIEEGKYDDAVARLYRINELIAQVQLTQKGLIDDDQLQTQKEFKVNISSTKSKAHARDNYDEILDFIDYNSSLKEKNKGYFGIANDKSYELLDLFGIKQSPKFDKLNSKLKERNGSILAHGLKPMNKKKAEELYDKTLDYAKDYFSFLDEDMDLAKFPKF

SEQ ID NO: 6777 - protein, 400 aa, Methanobrevibacter ruminantium
MMVRLQLETISPVYIGNTGNEYSRSEFAFAKFSGKKKLVRLNLDLVAKELYQRDEKLFKEFLKVLSDTKSFKNIKTKKDNSQFNKNERIAIKGMQKFLYDTIRPYDKDLFKKILSSCSSYKVSLQYAPESIKEKNGKKVSVTRKGESTADIGLIKENLKTNNEPYISGSSIKGAVRNALLYSRLNLSSKSNRDVAREINNKNNRDIKNIMTYVQFSDTFNTIEEPSLYGVESIGTKRNTFSFFETIDRGNVFEFEYRNTFNSKVHNPRMLNNFDLSVESIFKHIYEFSNDILDEEIRFIEDTVNFDYVYSDVDSGKLYKYFDDLKDKNTEESPLLRLGQGSGALGVSQLLEVKNSRSPTEFTTFRKFNRLGHKNHYDFPKTRKLIVNSFEPLGWVKLSKI

SEQ ID NO: 6778 - protein, 331 aa, Methanobrevibacter ruminantium
MYVCDKMKIVYLKPKSTFPFLSSDSIFGALTYGMAELFPEKLDSFIESFKNKNDIPFLISSAFPFIKNENNYFRFYPKPITKFQSKDMKLSKKFKKIKFIEEDIFLELVSGNISNDGIFDNFKDDLFLVNEFNESFLVKKENSEIIDGSLFSKEISPHNVIDRVKNNSINIFYSEDYRFRENKGLFFLVDFKDSSFEEIFISLLRFLRDKGFGHDISSGKGQFDFEIDDFDKFDNLNKSQYFLSLSRFIPDEKDISFIEELSDDDALYEIGDKRSRDSFGLRKKTRFFKEGSVFPDYTVKYDVNCGCLVETSDRSIEYGYSFNIPYNVEEL

SEQ ID NO: 6779 - protein, 255 aa, Methanobrevibacter ruminantium
MENLEFQGNVIIKGKIVCDTGLHIGESNETLEIGGIDNMVMRDKKSNLPYIPGSSLKGKLRHQMELFNKDSVRYILDNPKGRNREYAPCNCGKCSVCKIFGFTNDEDGTYVGPTRIIVRDAFPDDETKEFWESSEGVSRGAELKTENVIDRVKSTAMHPRPTERIPKDSKFDFEIVFGIYHDDDKENFKEIFTALKLLENNYLGGNGSRGYGKIHFEDLSYLIRNRSFYTDNAEEKVIELGVLSNLEDENLKIEL

SEQ ID NO: 6780 - protein, 143 aa, Methanobrevibacter ruminantium
MPNDLKDVENKIKGLKSLKYYEIEEFVKFDGDADKITKQLRNDDIKTSQLRKFFAAVKEIEMYVKDKRVWDDKAKVDFYLLMPKLAYAKGRKVISERFFNLMKITMEKVGSGNKEDTLDDFLRFVQFLEAIVAFFKVNNPGSL

SEQ ID NO: 6781 - protein, 885 aa, Methanobrevibacter ruminantium
MDRKNLEFASLLHDIGKFSYRAENNFSSEYKNLDKDDFGYHGAHSKWSASFIKHYWNSDITNLALYHHNPKSGINEEIGLIIQKADHHSSGERIDSIKNDPFKTPLLSIFSDILIKPEKNKKCDELYVPLEEFDLNRKWKNSIPTSIDNAKKGHNSLKKCYSALWEKFESEVKHLENTDDFNTILALLKKYTSCMPSATWGSKPDISLYDHSKTTAAIAVCRYLFNEETELKHTSSTQEVYSVISGDISGIQNFIFKISSPQKAQSAMSKRLRGRSLYLTLLTDAIANKIVQDLDLTQANILFCGGGRFTILAPNTEKAKKSLNEIQKEINAFFIEKFNAELYLAIASEECSGNGLENFSDITSILSYKIAQDKKHKFIDNLDDLFDFEEDLDGKSTCAVCGNLFKPKDEEDKFCDDCEEHIKLGSKVTNASYMIKCFFNEEFKNIYDKNKFKKVSFYEKPLNIAYIFTSNTSKKSVDKTFKEIKDILSEYDEFVDRFEIIKLNDTDFLEIENKFSLEELDKISFSFSFLGNTIPKYHNRNPLYFEHLAQISKGANKLGVLKMDVDDLGMIFGEGFNHAFKDSDESISSISRISTLSSQLDLFFSGFINKIASEFCVYDDGIKEYFKNDPSFFELNFKEVELKLQNDDGSKNEDESIIVYKEKYGMELDDEIKESIKEYSIPTIHINYSGGDDLLVLGPYDDIIEFSQELRTRFKQWTCNNDSINLSGGINIVSSKFPIGKAVIMAENYLEASKSCGKDKLTVFNEVVPWDAKGSKFKDFNQLHEFGLKLEEYNSQNKLSKSIVYSMLYLWKDNFEEHSGIFFNEEKWEKENFAKCNNNRFVPKFAYRLRGMNQNSKEYDVVLKEGIKYMPWIKIPVSWVSLRMR

SEQ ID NO: 6782 - protein, 1565 aa, Methanobrevibacter ruminantium
MSIDLNKNQKRAAYYNGDKYLVIEAGPGAGKTRVLIERIKFLINEEKVEPSSLLVITFTRKAAEELKERLYKDIDESVVSMMQISTIHAFCRVILSEIGEYNTRVLGDSVNEKQKMFLNKYKKDLGFVNECHIRQNEIFNLIDKYGEYATFKVDSKKLVDYIERNTKIDPEYIDFVNEYMKENDGRYPFDEVMANDAYKKSRTNALYLQIAKSYPKYLELLDEKGFSDFDQMQIKTLNYLKTNPNTIYKNVLVDEFQDTDPVQMKIFEILMKNADSFTVVGDIDQSIYGFRGANKNYFEYLYNNYDDRVYKVNLNVNYRSANQIIDISEDFIKSQRAEGAKQDKALGARDLDRNTYFLVNENSESEAKAIFEMIRYLHDSGKIENYNEIAILSRSIRFSNTAQDLIQLFIDNNIPYHVRGVPDLFDRPEIRSVITLIHHLIEDTNPHNHKFDLWELEWLNLKAYTGESFNQVLFNLSDETKNILNSIQEEFEENVLKEEKRAYLKVTGKKSHKYVFKRVFERDEKVLIELFKNIERPILSNENLIRYGVKNKQDLEFFRRLNDLKAYFNSEEYMDSEDTILDIYMKLLTDVCNYLTEDFINDPINRDELKNLAILSNTFHNYELIVDNKNLKGAYYFLRYNIAGYSTDNDESEGVQLMTVHKSKGLEFPVVILLSLNHKKFPSQYKDEYDRFYTPNSCLEYKNYDSKEEEIQDYLEEEDRIVYVAMTRAQDILVLSNLIKETPELEGLKAELNDNLSQIEKIEIIKDIPKGHIKIHDLINRNLSSCKFLEDDFSQLPKTVCEKPQVKKEDFLNLSFYSLENYVACPFKYKLMHDINFSESTMEFNKLRGLFVHNLLETINNRIRSNGNRYIGDDEVLAIFERFQDSFRFENLRLSKKEYDIIKNDVLYYYNTFGKDFNILNTELSFSIKKEYYGLSGIIDLIYKTKDGKMGILDYKNTERISRHYVQNYIKQVYTYMIALKDSFEIDELRIYAIKARKMISVDINQKSLDILLEELDNVSLNIKKEVFECNFGEGCLKCSFSKICVKANNDDVSVFDFNNEDTLSFRNKFYQNLPDYEIIDLKDRYWKDIDFDSDDETKFDVDISADDLASISAKEGVSVSANEGIPISAREGVSVSANEGIPISAKEGVSVSDKDNDLSVSANQIKNLNNSSDDKHLGADFKSKKDSFKSEMKSPSSKKDSSKSKKKSYKSKESSKSSKEPFISSYSKYLDLKSIPKKYKNFLKNDYSKDIDLFEYDDDLSLEENILRKYILKKKGLKLLKKELYDESEDYYKKLIHNSYFKEDYYPYKQLMKVYHKTKKYDKEADIIRDFFKSSVYANKYQFLYFKYKNRKLPKRARIKHNELKDLIKNYVNLLKDSDLSNNSIPNADRLKKDKNRLKILSDEEEFYNHKRSYYTNIADGLYEEKLNQEAFDLYAMAIYKYKEKSFRYYQRLASIYRRTNNYKHELLVIMEYFNKSNKIHRTKSSDKWFKQRLYSTKQLIGDENAIRQIENIVCKKGYNLKADYALNYLNHDLDEYYCLKNLDKELNYIISSNEDIFTLHKKK

SEQ ID NO: 6783 - protein, 398 aa, Methanobrevibacter ruminantium
MNETTSNELIHARRLYMKKNMKEAETNFLKVFNTNRELFNDLDEIYFIRAIQESHIDNCQSIGDLRHYADFVVENFNQEDCSNRNFEDPYADFILNLSTVLIKEEYYLDAIKYLIRLDESFLSDVSRHNSNGYYRFSHHEKYLSNMVKALIGIGKYDAALQYSIRLINDLPDTASEAKYWIKWSIAKIYNLTGDYELSIEYINELLLKRSENYFYKLLADNYLKLDDYDNALVSGVHYIILKKDIKSCVNYYTELGYILSQLGLTEESNKHYYLSYAIKKSYGNFIPDYLEEKIRDLGFDLENTNYNKIANELKPFWRECLYRNKKQFTGTISAIKQERGFGFIKPDDGGKNQFFLFKDFKDDHDYIWNNMRVSYYLGDSIDYSKNKESTRAVNVELI

SEQ ID NO: 6784 - protein, 564 aa, Methanobrevibacter ruminantium
MSSQLEELKKEFQIAEYNLDFDRLHTLCDKILEHDPNLIEYKQYIAISYFLSEDYENCIKEYSIYLDRREKDADDAYILAMSHLHLNNESEAMSIIEGFDEIDSLELKLKAYHDIKHYYKAIKAGNELLDIDSSNDEALQTMSEIYDELNNTEMSLFYEWELCKLKPAFKGFHLMRLYELGRYEEVIEIFERNPDDFKCDLLHYPFNFLIGSSYCEIGKHMDALKYLYRSNQLHECRDTGLQIARNYYILKDYEMAYKILKGVAVKEGLLDYDDSLSDDELLNDNSLLLLDEDGLEDDSLLLSDNETLNDDSLLLSEDKTLNNDSLFLREDKTLEQIMDKYCKGAPEEKADEKTCNEEEKETEVLSDIQILDQMLLELDIDESHYTQVEEEPSYFKETDEDSIDGDEDIDIVDANILRMMSEVCLYLKRYDECIMIANRLLSVSDRYDEIVNVISAYYLEMEDEWKADEWYLLLPIELAFNKPFVYTIARNLSLIGESDRALKIYSTIEKLIDESPYLLYERAGLYKRIGEKELAMKDLDKYNEIALKYLYENGEPEVKYEDLE

SEQ ID NO: 6785 - protein, 429 aa, Methanobrevibacter ruminantium
MKRKEVVLFMTVGTGINPDSNEAGYKKLAKKLYSTLNKIYPNYVIFFASNVSKHTIKYIDALFELDGDEFNEGEDYEIVELNNIDDFNYCFESFEAKIWEYDYLNEKKYQIIMDYTSGTKTMSAAMACCGMLYSRDLISVGGDRSKGEVSAGTEIINYQNLYKIYDKRAIMRIRYNFNTNRFQPCLDVLNYIVDMNIHKDSLVDLCKGYFAWDTMDFSHAYEHLKSIDLNYMEFAEIKNELKKNLNALGIIVNSKSQNLKNCYILACIINNAIRRAEEYKFDDAIARLYRSFELIAQIRLEKYNLMSSDIDIDLLKEKGLRQEFIDELENMREDGKIRIGLIKDYHLLNELDDELGKYFMENESKIKDLTFKRNNSILAHGLDSQSKEDFDKFLELVIGLAKKLDKDMNKFLEETRFAKFDLKLDINNA

SEQ ID NO: 6786 - protein, 112 aa, Methanobrevibacter ruminantium
MYKIINEDGSLVRGYPSDALYDLLTDKEKEHIQLFKNEIEKITEKEGLGKITVSVSYDEPIIEKAFQIQDKNGYSFDEFQEILDKIRLHMADFCKNNKELCEFKKFSYIISA

SEQ ID NO: 6787 - protein, 89 aa, Methanobrevibacter ruminantium
MMVSDKDLAKNNNVKGSRINVTPLMAAYFLGYMLSEKGEKISDEKIEDLYKGACFSMGIDPVEDISELFNELFSPKKKTKEDLENSFYC

SEQ ID NO: 6788 - protein, 468 aa, Methanobrevibacter ruminantium
MIHLGAIMSNIVDRIGMEKSVILLAAVVSFVTAFLANISVALPLIARELAMSNIIQNWVATIYLLPIAMLSIPLGKLTSKHGLNKSLLAGIILTIIGVIIACFSINSELLLLSRVIQGIGTALINVASMALIVSAVNPETRGQALGLNIAGVYIGLSSAPVIGGLVIYHLGWQSIFYIMLIPLIFSAYLSWSLKDEWTMYDGPIDITGSIIFSIGILLVIYGFTIVNTWLGIVLLIIGLLLLIAFAYFELRVNNPVFDVRLFKNSRFSSSNIASLISYTATFVITYILTYHFQYIMGFDSKFSGMLLIVTPVMMAILAPLSGRLSDRIDPQKLAAIGMGFVTVALTILCFLNESTPLYMILLAMFLQGIGYGLFSSPNTNAIMSSVPKEETSSASASLAAVRVIGQTLSLGMLTVIFAYIMGNVAIVPEYYPLLMESSRLSCIISAVLCVIAVVASLVGLRSDDEYET

SEQ ID NO: 6789 - protein, 249 aa, Methanobrevibacter ruminantium
MNSKQKALMVLALSIILLSSIAAASAEDYSLTNAKIDMVIQDDGLVFVDEAITYHFYKTMNGVYRYIPINNFNMEDFAVDVDGAYYELEGNDDDSQIEAKVYLYKDKDKTEKIDPGTDVTVHYKYYMSDLLDVKGDNAVLNYYLLGEDWEVDLEEIEANVHFPEKKELDYELVPSGSAEGKWSGDTLTITGENINAGDGLALIVEIPLDEFASGFSNAVHNDTDDDDDIDNDIDNDKDDLKDLTKAKQI

SEQ ID NO: 6790 - protein, 162 aa, Methanobrevibacter ruminantium
MKLKYFAVCLFVLILAAGISAAYATDVDFEGGHSFTMPDGYEIVEGQNTTEDIIMEKNGDNRIVFQYWIDEYEDLKNIEENYNFGDIIKAVMEDAVIGNEENYTFEDYDVTQIDYKVQGIQCYSYILDNGKEGYVIHHIAKEDLKDLNDPDNVIGDLVKSIK

SEQ ID NO: 6791 - protein, 70 aa, Methanobrevibacter ruminantium
MTYNCCLKTSREYTEEGLLNLIAETFDTDVSGLKVENIDSYEDDRGENFIITCSKEEGNMKTIKVFHAYG

SEQ ID NO: 6792 - protein, 69 aa, Methanobrevibacter ruminantium
MKDMEYPNEEAKEKFEEIMLRRLRLLYGIDVSEMEIINISLGESSVEPTIRIVLIDSTEEDCIRVFEIA

SEQ ID NO: 6793 - protein, 490 aa, Methanobrevibacter ruminantium
MKQHSVGRVETKTFAINDKLKLSSGKTLENVELAYETYGELNTAKTNAILVCHALTGDAHAAGWHKNATKPGWWEIVIGPGKALDTDKYFVICSNVLGGCKGSTGPASINPKTNEEYALDFPIITIEDMVHAQKKLIEHLGIEKLHAVVGGSMGGMQALQWTVSYPNMMKKASIIATTARSSPQQIAFNEVGRQSIISDPFWNNGQYYGKNRTPRSGLAVARMIGHITYLSDESMYIKFGRELQDKDQLSYDFTLDFQVESYLHHQGESFVKRFDANSYLYITKAVDYFDLSVDGSLPDGLKNVKAKFQIIAVDSDWLYPVDQSKDLLTALQTLGVEVSYNEVKSDYGHDAFLLENGQMNFLLNNFLSENVVDDLMKTDVPTIDINSTIKDAANIMFDNQVTHLPVVDENDKLLGIVTAWDLSKSIAKDCKLLEDVMTKDVRYCKSTDSIEYISRQMKKFDISCLPVVNDDLCLEGIITTDQISHLISSY

SEQ ID NO: 6794 - protein, 66 aa, Methanobrevibacter ruminantium
MTHLTITEYREMVKDIIEFKNENGKMPDFASVNNQEISHENYSAMINDVNNYILQHGRSPEFVQIK

SEQ ID NO: 6795 - protein, 497 aa, Methanobrevibacter ruminantium
MSFSDKIYNAKPGYTYDDFLLVPNASWIEAKDVDTKINLTKDIKLNIPIMSAAMDTVTEADLAIALAQEGGIGVIHRNINQEAQVAEVRKVKSAEDITVRDVVTISPDSSIETVQDIMENESVSGLPVMEGDRIVGIISKRDVRPFLKNDSKRLVKEIMTSDVVTIKENISQEEALDIAYENKVERLPVVNEDGALVGILTIKDILNQDQHPNAAVDKNGKYLVAAACGPFDLDRAMALDEAGADIISIDCAHAHNMNVVKFAETIKDNIDADLCMGNIATKEAAEDLIAHGADGLKVGIGPGSICTTRIVAGIGVPQLTAIADVADVAGEAGIPVIADGGLRYSGDIAKAIGAGADVVMLGNLLAGTLEAPGDVVTMNGRKFKQYRGMGSMGAMTGGSGGGADRYFQELEKGSHMKHSKLVPEGVEGVVPYKGTVAEVVFQLVGGLKSSMGYCGAKDIQTMKEVARFVRITTSGIKESHPHDFLITNESPNYPTLD

SEQ ID NO: 6796 - protein, 239 aa, Methanobrevibacter ruminantium
MLLLISPINHEEAVESIEGGADIVDVKNPKEGSLGANFPWVIKDIRELTPKDMLVSATLGDVPYKPGTVSLAAMGALVSGADYIKVGLYGPSNYEEGVEVMKGVVKAVKDTNPDATVVASGYADAHRVGAVSPWDIPKVAKDSGADIAMLDTAVKDGHTLFDYLDIDDCRKFTEEAHSYGLKVALAGSVKKDQLKPLYDVGCDVVGVRGAACVGGDRNTGHIDRTAVAELKELVQSFEE

SEQ ID NO: 6797 - protein, 2416 aa, Methanobrevibacter ruminantium
MKLKLIYLICMICCVLLTFSTVSAIDMDGNLTASVNHLDGSHSDQSAFISQSESSKTNLNANNNLRVSSGDYDCVETMNELSNLDSKDSKDNNLSKDKTSLKSDLNSIDSDEYSLKSSLSSINSSKKSSYEDGDNEYENLEDSLDSKNKNSLSSNALGAGTSTFGDLQTMINNAQEGSTINLDGKTFIGNGSFITIKKAITINGGSATNLARFDARNLSYIFKISASNVHIKNCYFSYSTNCSVYFFGNGSSIDNCHFDYNYKHLWVAVNIKYFSLTNCNFTNGKTDMGSTAYVVADNATVKNCNFINNEASGTEQCYGAALQIGASSSGINEGYVVNCTFINNRVITTHSYSHAGALCFRPGIKVYNSTFINNYCNRMGGATTLHSDGEIMNCTFINNSAGEYGGAISTGLMADNISVNITGCTFINNYAPMGGAILIKGNNVKVTNSTFKENKARENDGGAVYILGNDALILNSTFQSNYAKNVGAGILINGSYVTVLNSSFARNNASYGAGIYVIGSNANLFSSNFTNHNVKNGSVYIKGIGAYVYNCNFASNTGENGAALYIEGSNTTLILSNFTNNNVTKDGGAIYVVGSNAKLMASNFLYNNAIPSESDIKSGLGGAVYIKGNSNTIDSSSFKYNTARNGSAIYTDGKNMNLSNDNFDRNQAWSYVLDSVIKPSSSYFNRSDILINLTLIGGNNIANAIYNTASVNDIYFYNVSYISSKGKKVTTSNEIHPVNGASNSQNGALLYQDDREDNQLVNVIVYKDPNSKSTSLSAINKNDIILNKTFTTGILGNVSLNLSSSVGKAIAPGNYLLYAKHTEDDYYKEIDEDNQFEILPLVDVAVDIVSSKDIVEYNRTNKFTVKVINNGPNNATDVQVSAVLPKGLILVSSSPSVGTYNSSTGIWTIGNLNSGVNQTLAINTRANTTGAVNYPVSVSSYEKDTNEANNKDNQSIKIPECDLLIDIASSNHSPKYSDIVNWTVTVKNNGPDDASKVVVSLGNLSGNELIYQKSTNANFNISTQTLELSKLASGSNVSFVITTKVNASNKKITVNSSVSSDTFEYNLNNNQDNDYVNVAPLCDVGITVKVSNRTANRNDLVKWTITVKNYGPDKASNVNVALSDLASLGLGLVNKSDANYASNEWNVGDLNKDASKELVISTKVNTENKNIVLKGTVNTSTYETNKANNLANDTLSVNPYCDVLIEVTASDNSANKNDVITWTVNVKNNGPNQAKDVKVSLTNMEKLGLIVQNRSFTFKDIAVLENSTFNFNKSSNIWSIGSMASGDISSMTVKTKVNCSDKVLSVEGNVSTSTYELNKANNHDDDLLTVEELCDLAVEVNASKKTANKGDIVNWTIKIKNNGPDTASDVFLTVSDLESLGMVFVNSSSKDFDSESFAWEIGELASGKGLTLILATQVDTSDETIMVEADVDTSTYELNKANNADNDSLNVNPCCDIVIDISVSDSPVNKEDIVNWTIVVTNDGPDDAKAVVVNLTDLEPLALIIMNVSESSYDNGQWTIGDLPDGESQSLIITTKANCSNDTIKLDGIVDTSTFELDKSNNHNDDILEIDPLCDLSIEISVSDSPVNNGDIVNWTIVVANDGPDGASDVIVSLSDLESLNLEILNVSEDNFNPETYEWIIGDLDNNENASLIISAKVNTSDDILDVESTVDSKTFELNKDNNYDNESLIVNPLCDLIIDISVSDSPVNTEDLVDWTITVTNDGPDMAENVKVYLNDLDALNLILVNASEDSFDGDAYQWIIGNLDNGDAVELLITTRVNASNKTIEVESAVLSDTFELNKENNYDNDTVTVNPLCDLIVVVDVSNSTINKDEVVNWTITVTNDGPDTAENVILDLSDLEDLGLIVLNVSDDSYNPESGKWIIGDLAPGETVDLIVTTQANVSNASLPVEAIVQGDTYELNKDNNHDDKLLDVNPLCDLVIEITVSNSSVNKGGTVEWTIVVYNDGPDDASDVIVTLDDLKTLGLILSNVTYGTTSMDISYDGSRLFVKDISSEDSENSDSIDESDSSSPNMLKASSKLDGVGSDLDNGELKSLKSGSYLSDDSSNDSDKASNTFDEETNLWYIGDLAKGNSISLKLLTEVNRSNDNITLPSNVDTSTYEVVKSNNFDSAIVEVLPLADNGDNESVNSSDSNGDNPLDGDGNSTSDGSNPDGDNSSDGDGNSTSDGSDPNGGNGDEPLDGDGNNSSNGSGNPDGSDSNGDNPLDGDGNSTSDGSDNSDGDNKSGDNSGNPDGSDSNGDNPLDGDGNSTSDGSGNPDGSGSSDGDNSGNSDAGEKSDDGSSDTDGSGNTDGNGSLDEDGDNDSGSGSGNYGSDLYDMYPWDDYMDNKTNDGSNKNNQGDNNSHAGKKVKNPTKKNLSNHVQAKQQKGVPMKNTGHPLALLVLTIFALFTLSYRKFKF

SEQ ID NO: 6798 - protein, 409 aa, Methanobrevibacter ruminantium
MKEEEIESMRKIFSQLKDKIEPLSQSPAIQALQKRVMEIRKEAIKNNSQLLETVQNSFKENDIDCFLASNDIEAQKIILDLINEEIESNPNIDSNDVYICKSKSNTLREIGFLELMEENNYNVIETDLGDRILQLKKEDNDPVHPTGPASHLTVSDIADIVNQSMDLNLNPVPKEIMEAVRSDVLNLMHKSYIGISGSNSIAAEDGAILMVHNEGNISFVQSKKLHIIVAGIDKLVPHLEDSVSIAKLETAYATGKPLTSYMNIVSGPSKTADIEKKLLKNMYGAERVAVILLDNGRSKAIDECLWCIGCGNCIVSCPVYNIIGNKFGYSSYLGGRGIALSRYLKDNEVSVDSGLYMCTLCGMCTENCPVLTPTYEIIENLRCDSQKEGLFRNQHKSIRDNIKNKGSPY

SEQ ID NO: 6799 - protein, 252 aa, Methanobrevibacter ruminantium
MLLYFRGCTAREKLDSISEATQSLLKLFNIEYEILDNEQCCGSVLLRTGFKEDGIEQMNKTYSDIKGKTILTSCAGCYKTLKEDYKTYLDADLEVIHISQLLNELINENSINKLDKDLLITYHDPCHLGRHAGEYEAPRSVIKTFSNLTEMKNIKEKSRCCGSGGGVKSAYGDLSNSIAKLRIAEANETGADLLVSACPFCKLNLSQNSDDLEVLDLSEFVLKMLKESDLDLSNLKMLEEDNLELSKNKKME

SEQ ID NO: 6800 - protein, 152 aa, Methanobrevibacter ruminantium
MRIGIADTTFARYDMGAAAIDELKKNASDLKIIRRTVPGVKDLPVASKKLIEEEGCEIVMALGMPGPMEKDKMCAHEASTGLIRAQLMTNTHILEVFVHEDEEEDPKELKKLADNRAREHAQNLIKMMFHPRLMEKEAGKGMREGKEDVGPL

SEQ ID NO: 6801 - protein, 396 aa, Methanobrevibacter ruminantium
MPKEEIDKIKRNLSGNPDLDRDYLVSQLEYYKGHEYSYEIIKEISHLILQSLDFYLIEDIGSKKTMASRILDEVMQYIETRDKRTAKEKLDKYMESFVDKYENKEDHKESDFNSNRSIREIQYIRYRENKLADSPKSFRVSPKKDRQVNWRKDVKIKKMESNSIEEIHEKEYHSFLNPLEEILFYHYIGLKKELAYIPFNEPLFDLYYLYGTLLFESDEYGKSEEYLLKALRINPVSSKTILALADIYKSKTRTYNRFFLYNVDALKFAYRNEDIARAYRNFGFFYVEENQLDVAAAFYDFSLNYDYNKHVVKELEYLKSRGVDTQIETEEAVGIIESKNIQVGVNDFVLDALKFICFDLDSRKHTSQALYFYRILYDLTKDNQVLGRINALSNKI

SEQ ID NO: 6802 - protein, 253 aa, Methanobrevibacter ruminantium
MEKGEMVSLLGRNGAGKSTLFLHFNGIHQPKSGEIYIDGEKLSYGKEELMLARQKVGIVFQNPDNQLFAPTVEEDVAFGPMNLGLPIEEVEKRVKDSLEKVGMGGFEKKSPHHLSGGQKKRIAIAGILAMEPEIMILDEPTSGLDPKGASHILKLLYSLNEEGMTIVISTHDVGLVPVYSSKIFLISDGEIIKSGTPKEVFSDVETIRKADLRLPRVTHLAEILEKNNDIDFGGEYPLTIGEARQKILDLLGK

SEQ ID NO: 6803 - protein, 367 aa, Methanobrevibacter ruminantium
MTNDDKTQEFKLISKTIDGDEIFLNHDSIVVKFAGKRNAIVTSWLNGGYSEDLSAVFNHQLSQENIDEYGDGGILGFLEMLSYDFYNKLDLKGNKLSGLVTSAQIDEYSIAVERYKDIEVLAITTAGVRVNAVSAGDVASYYELNGEYDFDLENEDPNPNKPGTINNIILINCRLDESSLLLAEMIAVEAKAVALRDLMTSSNYSSEIATGTGTDGIAICSNLQSDNFIENVSKHAKIGELIANAVIRSIKEALANLQWLTPSYQLNALVRLDRFKMNLDEFYDKSLNLDEMEKKEFIMSLIKVSKNPELVGYVSLIIHIIDQYRIGLLDKKPALKVLNSILNSNFNRKEWNSMKLLLEYVIEKQIE

SEQ ID NO: 6804 - protein, 645 aa, Methanobrevibacter ruminantium
MALIEFKNFSFSYLNSDGTESLEKSLDNISLNINFGDFVLLCGPSGCGKTTLLTNLKKELMPNGRREGSIKYNGTEIAQLDDFTSACDIGYLFQNPDSQIVTDTVIQEIAFPLENIGLPTEEIRNRISEIVAFFGINDILHKNVNELSGGQKQLINLCSLLVLRPKVLLLDEPMSQLDPIASYEFLSIIRRLNEEFSITVIMSEHKADSIFPFIDNAVFLKDGKIEFNDNAHDICEEVINDDIFENYLPAVTKIYNGLSQNYLENEEYISEYEEFTKLNTPLSIREGRRYLNIISDELIKINEDVQKNNNFENDYAYDSLEKDNSNQNSTSSKKEHDYYQKSSLTTKKYNSNKLGLRDRLPFSNDKNTLIRMNGIYFAYEKNNLILKNVDFKLNKGDFLSLVGGNGVGKSTFLQILVGILKPIKGKVRYSKNLKIAYVHQNPMIHFSKDTVKEEFLESILSSNAFSASEFNMETYDGLLKLNGNEFLESDLLNNLKFKNIDYRFKELIGFFDIENLLDKHPYDCSGGEQEKIVIVKALIQNTDVLVLDEPTKGLDPISSKNLAYILNSLVDNGLTIVMTSHDLDFVANNCKRCLMLFDKDIQIDDDPKVIFAENNFYTTFVNRMVKDYIPQAVTLDDVKEIWDLK

SEQ ID NO: 6805 - protein, 334 aa, Methanobrevibacter ruminantium
MVLLAFIFSDPYFVLSFLALILILIALQGVSSELKNIMKFFIPLSVLIIILNPLLNRTGAHRIYLFNGFFITYEAIAYGILMSLALLIVILVFSSYNRSVSYQEMLYIFSKKLPIISMIIVMALRFIPLINSRAIEVQKLNNLKANGVESDEEDDLNDDSLEDNLSEENNLSDENNSKEDSDSLDLEQFDSNISSLDIGSDSRVFKKIKSSKRFQSIAKEAKVLGKIMGITVSWSLEESMFTAKSMKARGYNSNERTSYLSYKFGLADIIFLAIIIVTVSIIVIGLIQGYGMINIYPSIDFSFSDLPFNIYYFAFIVFLLPLIYLEIKERFLWR

SEQ ID NO: 6806 - protein, 615 aa, Methanobrevibacter ruminantium
MSTKVHSPDELPQKPGIYIMKDINEEIIYVGKSKSLRNRVKSYFQKNLDSPKTKVLMSHFNSLEYIVTNTEKEALILEANLIKKHRPRYNIRLKDDKRYPYVKITDEDFPKIVITRTISKTGTYYGPFTDVTAVRQTVKFLKQLFRIRTCKRMDGPCLNSQIDLCYAPCDGQISKEEYKEHIKKIDLFFQGKYNKIIKDLEIEMKQAAERQEYEKAAVIRDQISSIDEVMKKQFVEFENDLDQDIIAIAYTIHNAVAVVMNIRNGKIMGKDDFTMDGSENTTSDEVISAFIKQYYGINRHIPKEVLLEEDIPDKELIEEWLSDLRGNKVSLKVPQKGNKLRLVRMAGKNAEIIKNQRQKMENSMMELKRYLNLKKLPRVIEGYDISNISGKLAVGSKVSFLDGKPNKKQYKKFKMNTPGPNDFAMMKELLERRLKPLKEHYEKVRINEEHTKHNEAETEKIEPLKLGEEPNLIVIDGGKGQLGMAVDVLKEYNLTHIPIIGLAKEFEEIYIPNSSFPIIIPQDNEALHLLQQVRDESHRFAVTYHRKLRSKKIEESPLDEIEGIGKKRKLELLRHFGDFDSIKKASVEELKGVDGMNEKVALNVYNYFHEGEKEQ

SEQ ID NO: 6807 - protein, 180 aa, Methanobrevibacter ruminantium
MKVIGVTGLPGSGKSILFDTAEEKGALVVCMGDLVREKAAERGEDSGTTARKLREEFGQYIVAELTIERIKEILEKDKDAKIILVDGIRSPYEIELFKESFDNFISVSIYASPQTRFERLVLRNREDDPEVYEDFLVRDNREIGFGIAEVVATADYMLNNECSLEEFKQSVADFIEKEMD

SEQ ID NO: 6808 - protein, 248 aa, Methanobrevibacter ruminantium
MIPKTHPRYESLLLRDKVKNAFKEGYLADSGMIAHGRGETFDYLIGERTTEPARKACEAAVAYILLAENPVLSVNGNTTALAIDEIIELAKATDSKIEINLFYRTPERVEIIERMFKERGWEDILGGNDEKLEYIDNLNSPRATASKEGSYIADVMLVPLEDGDRAEVLVQNGKKIICIDLNPLSRTSKMSTVSIVDNIVRAVPLMTSMALDFKEKGKDKDKEFLENIIKNFSNEQNLKDSLAEIKLK

SEQ ID NO: 6809 - protein, 192 aa, Methanobrevibacter ruminantium
MKRFIAIDGLDGSGKDTQARKIKEKYEQEGTVVIRSHPTSDNFFGRHSKSALEKKGKLNKIIATLCYGADAIRSVIKYYGKYDTVIFVRYTLAVSYLSKAISVPVYKLVCVLLPISEYFFYLDVSPKELVRRVKSRNEKEEMFENYDAFVKVRKMAEPVLYNWNVIPADDSPDEIFSRIEAILDELDKKLLE

SEQ ID NO: 6810 - protein, 175 aa, Methanobrevibacter ruminantium
MDEKIENPELKAIMAIDPEEMDEDQLNKFVEAFMEATLIVPAEMETDIDIEGMSDEEIALNEEIEITIIKLEDDEGHEFIPAYTDDEEVEKLDFDVYGLIFKTEDLANLLYESEDELEAVVLNPFTEYSAEIPLDSLFELFDLEECDDPNCDNPHHHHHDHEHNHEHHHDHEHEH

SEQ ID NO: 6811 - protein, 188 aa, Methanobrevibacter ruminantium
MKSSITKEDYLRIYEMTDDVFTLDFDCGKLCNNICCTIEKEAKDDEYLEMVLYLLPGEEELFFENQWFEMYYETTDEYEYPDSWKGKVYYVKCSDPPYCDRKRRPIQCRSFPVSPHLDKDNKLHLIYDEDDFSYDCPIVSQKMELSDNFKEKILKMWSILIEDELIFDLIKMESVQRENNEKEYDFVF

SEQ ID NO: 6812 - protein, 199 aa, Methanobrevibacter ruminantium
MNKKRFKLLLTIFIAFALINTCFILNDNLSAADNAPKGYSNYYIRGVCFNVPDSYKLVDEGWDDVNRLSYAHFKKGNNFLNISLDKHSTKFNKNLLDGFSSFTINGINLNKKTISHVTGFYAKKNGVKHFVFATEDDFVYIAAKGPKLKDVLSSTNQRDYKPYHDSEYDFDDDAYYESDVYDDSFDDSFDDGAYYGYDW

SEQ ID NO: 6813 - protein, 227 aa, Methanobrevibacter ruminantium
MKSAVLFSGGKDSAMALNYAINNGDDVRYLLSMKSQNDESYMFHVPNIHMTDLISQAVEIPLMEVETDGVKEEELKDLRRGFIQLKEEGIEAIYTGALFSTYQKSRIENLADETGIKAISPYWHKDPKEYMELVLETGFKVIISGVFAEGLDEKWLGRLIDAQALQELEKISEKTYLNLAFEGGEAETLVIDGPIFKKRIEIVDAETDWHLDNGTYNVIEARLVEKE

SEQ ID NO: 6814 - protein, 193 aa, Methanobrevibacter ruminantium
MFDKSIAKKSSLPFKSINNNSLFKFISINKCLFKFISINNKGLFKFISIDNKGQLSLEYILSAMMVILLITLLSVPILSLTIDYSNDVINSISTKNELSKITDSIDFCYYSGKGSKKVVLLDFNQDFSVRFTNNGQKGIAYADLELSDNNHKEISSEYDYIGLNTNIQFSKGFNKILVEWDEDTGLIRLSKLN

SEQ ID NO: 6815 - protein, 302 aa, Methanobrevibacter ruminantium
MNIYILFWNIFNNIDFYLMSGFIMVFFTLLLANYYDLKYGIIPNKLSVFLMTFGILINVLILIVLNNRLYAIFYVSYLIIIFIISFVLWKISFWGGGDLKLFCSIGFSLPFIDILNHFYTGSILNSFSFNSQIILYPKIFSILINSILLSFPVILLLLVYKLLRENKLNLILFAFSNMKLLIKELSTKTVFINDLKEGMIVEDYYFNSLELFNLMEELTGNEECYNLKASQFKENSYVLKSSSMAGLTRDDIKLINFAYMETLINFPNFKIKMGVPFVPSLTVGYLVFLAFGDLVFLISTII

SEQ ID NO: 6816 - protein, 71 aa, Methanobrevibacter ruminantium
MMASILRNQVNFTFSYNFHMMASILRNQVNFTFSYNFHTMKSIYYLEVNFTKSSKFYEMTSILRDDINFTF

SEQ ID NO: 6817 - protein, 199 aa, Methanobrevibacter ruminantium
MNDLDNNLANAKGIGKTIATKVPMNVHDELVHLVDCGAYLSISDFLREAIREQLKNYKIADMRKINYQDAKREVISYFKKYKVCFLDEIAINLELEFELVNTILNDLVMEERIKMISKADQVFKDYLEENDLDESQHFSNKGNNFIKFKGKRIIVESSSKDVDFISLRPSPKNKSVLKSHGMVLNNGTVILSECYIFLK

SEQ ID NO: 6818 - protein, 558 aa, Methanobrevibacter ruminantium
MDFYKDSRFFQNFKEWIYLTKYIIITGGVVSSIGKGITSASIGRILRSYGLKVAAIKIDPYLNWDSGTLNPYQHGEVFVTYDGMETDLDLGHYERFLDVELPGISNITTGKVYQSVITKERNGDFLGACVQIIPHITNEIKEMVREISAKDDYDVVLVELGGTVGDIESQPFLEALRQLRNEEGSENVMFVHVTFVPYLNAAGEFKTKPTQHSSKELRSMGINPNMIVLRSQEPIDDDLKRKIAHFCDVDVKAVVNTPDAQSIYEVPLVLDRENAGQYISDRINLGIDFENDKNTLNEWEEIVNSLKIQDPVVTIGIVGKYVELEDAYISIRESLHHAAAKIGAKMNIEYLSSDVDVEDVDELKAFKEELSKLDGILIPGGFGDRGVEGKFQAVDYAIENDVPIFGICLGMQCMVIQFARRIGMEGANSSEFNTETPYPVIDMMEEQKKIKKMGGTMRLGAYDCKLIDGTRTMEAYGEENIQERHRHRFEYNNEYRDVLTENGLVIAGTTPDNFLVEIVELPDHPWFIGCQFHPEFKSRPNNAHPLFASFVQAAFDNK

SEQ ID NO: 6819 - protein, 126 aa, Methanobrevibacter ruminantium
MDTKTITAELNEEQYKKYQIMQENNLSVGEAIDLIFNLREEFELQANDYLEERLAELNDKKESLSKEMSSIDDELNVLKKIVDSPMDFKQKRDIIEKEYASFDETYDIKVIRAKHQVSWVTDFFKF

SEQ ID NO: 6820 - protein, 150 aa, Methanobrevibacter ruminantium
MNKDNSSLNKNNLNLEKENSSLEKILKPESKLNSSLDLVSNMISDLDSDIESRLNSDLESSSSSFSDLYRNYLIEDNEIYLEMSISKDEFFKMMKFLYVLIDSYRLELNNIEVLDTGDGLLNICSSILMEDESNIKIIEAFLINNDFGND

SEQ ID NO: 6821 - protein, 247 aa, Methanobrevibacter ruminantium
MLLKIIENKKIKANQKEFDRFLERFHNNKKTFTVDCDHINLDYFNSESYVTIRHRKPNKESIYYTSFFKERDEVTYLFGLARENVVCTSSYMDMGAQIRPTLVAVLNLEDSSKSTIVFAEDSEEYNNVILLRIDCSQLNNDELTVLKNKNKITKLKDGKGFINFGAIGDFTTLKNIRNFISNVTFEYDNGLYAKIINVSIPINNSFSKPDSDVLKDRFYNFDKLDSDLVVIDPNEDDDSNKRILKIN

SEQ ID NO: 6822 - protein, 1562 aa, Methanobrevibacter ruminantium
MKNHSFMFLDSDFQDISNFCMRMEKNIVEGDGVDAVIWAGKIAERVTHYITKFVGIDLNELDQNKKLNTLYSKGIIPEDKYNKLDSIRQYRNIATHHELRDEMNIAKKTHKDVFNILSWFYGTYKGDEAYYKLKYPGVTYRHDESFLNQLKENINNNVKTIDNNKATTAIKSANDHIYQHDVDYNVHSYFNQNNVEFNPELNAYTAFFIFDDKKVTIGHFKTREVAVRKGYRFVLNEDFRMFQYFNGCLLPERLEDGSYSDSKGIDFDMEEKLWKASFDDKDLGYFISENSAIIARKEYIDTLPLPESKNGSYSDYKEISFDLNHKLWYIKKEGKILDYYDSEREAIHNLSNVYRLDIDLEDLGIVQDKNDSRWKIFYKNKYVTTCDTKEEAIKKRLSHISSFAPPKRNKDGEYSIHKGIYYDDKNLIWVLTIKGETLGFFDSEEDAFNYKKEFLKSKGFDVSDLIFHQEELFDDSFDFKVRLNSEENAVDYDKDNDEWVIYFRGNEIGRKASEDEARKFRRAYLKEMPYPPRKSNGNYSFIDGIDYDINSHLWLAKNGEELIGHFDSEEDAFYGLKEALVKEGFDVRDMHFINSDIKSNDENDGNLSNIVNPSKDYLIKDNSTKDYLSDGSVSNEDSSAEASNQKDGSDKLISFYDVFRTNTGNYILSDSEESLSDSEESLSDSVESLSDSVESINKPVESADEDFKNNSESIANDSAFETDNGRGVIDQEFLADGDKQFNMGAIIQEDNSKNINEYKKSSFYGIANQNQDDRLSDDLSIPYLESEDNYEYMEDLNLEQLNLDENNGFLNISENLFKSSNRKELKEIKLNSYDSNNFRREMVLSYNDSYLCVSLQGMVNKDELKDIIFLDILDNMVKLNYSKVDEEYFSIFINVQYKLSTIDLVTLINLLSDLGWEFDLLDKLAISNDINLNSLVQSKIGKIRDKRKAHSNELIKSSHNEDSLISKSKINDSIVSNESDSNKGSSKFKENLSLYDKFSLSSNDAEDSDAQKAKDKSLKSKDYLDANPISKRKSYPKQESISSKNKKSNSKSEKAIIRGGVRVSLEEAHEIDNAEENKVIKSKIIDKKPEMVKDFKTTSLDSLLEANRIKEEERLNSTSDDIGDDLSIEDNSDTFKDDLNSNGLETLENGLNLIKEGLNSAENDLDYAEDVLNSEEDDLDSAEDVLNPEEDDLGSVEDVLNPEEDDLGSVEDVLNPEEDNYVSESSLNDDFDSLDYSDSLEDSTDSSFDYGDVLGEDNSNSNSIEDIFNDEDDLDSEGLLDEDSDDVDFLEKVSSDLSSTNLFDESADLSANDLFDGYNDSSSSDLFDDESETSFEDELDNIGSSNQEDLSTESNDSDSNLEEIGSLKETAEQTESESDSTASKVSKPKVKKAKKPKKVPADAFDEKYANSTEIEYDEESDKWLAFLGGDLIRSFNTPKEAYIERKKLLRRKVKRPKRGMNGRYSEFEGIDFNTQEGLWTSSVNDIIVCYSITEKEAHKKRTMFVDLILDKFDVSEEEFTEDLLEEIKSTNLEDLFADLSDEDLNDSSNLSLKEVKKELNKF

SEQ ID NO: 6823 - protein, 99 aa, Methanobrevibacter ruminantium
MEEIRKELIKFQMERDWKRYHTPENLAKSISIEAAELLEHFQWQKEYDKDEVVDELADVFNYCFLMADALDVDVKEIVFNKMKKNAIKYPPKVSSDDLK

SEQ ID NO: 6824 - protein, 257 aa, Methanobrevibacter ruminantium
MDDFLSNFVLKEEETSLSDSKKDVLKFLKQIGVDTRFVSFFEKDNEKRIYIENLRFSRFSRKRTSIFNNEYPDIEVVRSSLFQKICLRASKTLSNSLDPKDRVIIPKMDNEYNELLFIVLESYSRKYGIIFIEYDENENINLKDFNAIVSPLNLNQEVNHILNDIFDGKGIEWDRKFDLSSLYGFNASDIKDKKIIFPFINVPQEWIYDFLGIEKEYVIDYDNDDIGDSFMGFLSEINPQFKENVLAASSFLETHQK

SEQ ID NO: 6825 - protein, 298 aa, Methanobrevibacter ruminantium
MVDGKTKILGVIGDPIEHTFSPAMQNAGLEALNLNYIYLPFHVKSDNLNSAIEGAKTLGIRGLNVTIPHKREVITCLDEVDPIANMIGAVNTIKFDYDENEGISTKGYNTDAYGCLRAIEEKASVKDKKITIVGAGGASRAIAFQMASSDIGELSILNRNFNKAESLANDIKSNLKQLNDNFNLNINAYDMDSLKREIQESEILIDTTPIGMYPNINDKPIASADMMHDDLIVNDIVYTPMETSLIKEAKKANAEVVYGYKMLLYQGIRSFEIWLGEEAPVKEMENALLKVFRHLNGF

SEQ ID NO: 6826 - protein, 179 aa, Methanobrevibacter ruminantium
MNLCMTTLRMSLAEKRQHLSKLFLEVLKEHSGTISVYDLMSVTAELREDTKYVQDKYREETNAVYVKYFLGRIKNIRDDNNQYDGSIDKDDFIESVATLKSYQEGESKTSKTKFPLIYAIVSLYTTYILEEPIHPVGTPFPGSLKVTQKNGVFYCPVKEANLESPNAVCKMCIAEQLEF

SEQ ID NO: 6827 - protein, 1539 aa, Methanobrevibacter ruminantium
MSKTNKKKLFLSILIILSVLISLSSVSAINTNDSSIQDNGDLSIQDSIDEISQFDESEQLNKINKDSPESNFNQELSNDSKDISADSNQDLMGFENYDFKYNTKSSYSNALKDSNVINVTGSTFQDIQDAIDRANDGDILYLKSYKFHGNGTAISINKPLTIIGSYEANNKSHYLDAYLKSRILYIDSDDVTLINIHFDYGGNIDNNGNGGAIYLDGTNCAIVNCSFKGNHAWLGGAIFQSNNSNDLYVGGCKFVENNAQIGAGITTCGFNCLVSNCSFENNSAVTAGAIMTDTQKNGDMTFFRLENSTFINNNATGGGGAINFDGYYQSVYNCKFIDNYAKNSGGAIYGSLKPFDVSLCQFYNNYANTGGAIRGTANYNVSDCRFINNSAHHAGAVFLHSYSNVIDSYFENNYAEANGGAICTDSNTVGVIIKGSTLIGNNATTGSAIMMVSSRSIIENCNFSGNIGKSEGAIYSIHDCNISHCIFDSNQAEKGGAFYIYRGNNSNIDNCRFINNSANSSGGAIYWYVNKGKISNSYFEENQARYGSAIYCSNVEADSGFIITDCDFINNHPKEDGSNTKGGAIYLYDQLKCIIVANSTFEYNYASRGGAIYVEGDVNLIANSTFKYNKADIFSLSAYNDNANLIVTLRGYENYMNAIYAEKTVDFHNVTYWDGEFVTGDYPIKRNLEAGINIILDCRGNGHSLNVTKMTNSMGEVIFDEMRTLPSGTYAYQVSVPDNSYYTAKKLKPDIFNVPYLCENILGIDVADISYDQYPVVNITANYTGNYTVYIANSSYDVTFTDQDVERGRVLGYNITITDEDVVKGEKLIVIPHLFDIKDGYGAYVQLRAIDQENVELVYIQNRTSFNVYKAASALEAEGAVAVNGSDIELNYMAQNGTVTIESIKKDGSLLENGTDYNFTVNDDKIIITGLDAGHYIANLTLIVDDYHNSSSIDVSIDVLIKTSIDVADSISIAETESSLINATLSPEEAGLLNYQSDNETVAVIDNDGRITGILKGNATIFVSYAGNEDYSPSNATVKINVYPLVDLKINKTANVSKAFVDNMIKFTVSVVNDGPSNASGVYVDETLSSILDLISNSSTKGSYDGNKWLVGNLNNGESASLTIVAKINRAGIISNDVTVKANEADSNQSNNNCSISIEGLMIETVLTVPNVTSSYNMDKNFTISLKDINGNPIGDANITVDLNGKKSYITDSNGQIKLSTTGLAVDTHVLNVTFAGNYKYNGSSSSSKIVIIKDSSKLNATDIISTYNDDDYLIVSLTNSQNNPIAGANVFVDLAGKRNYTTDSNGQIKVSLKNLIPDNYNASIAFGGNENYTESSTSAMVTVKRAKTSFNYTDMNTVAFDSKLEGRVGEYFKFKLLDNNGKPIAGRQVFIGFNGVKYNRTTNETGEAQLQINLKYANHYTFAIAFLGDDCYSGSFNVALISVTEQTPVLTTSPKTYKSSAKTKVLTATLKSSRESALPGKKVTFTINGKVYSANTNEDGIATVKVSLSKKGTYSFTVQFGGDSTYKKITKSSKLTIK

SEQ ID NO: 6828 - protein, 1686 aa, Methanobrevibacter ruminantium
MDKKVSKTNKKKLLLSILILFSILVSLSSVSAASDLIQDYEDLTIQNSYDDLIIQDSFNEDLIQDSSNTELKTQDSSIDNLKETINQTESIDDTLTNQDLSSLQDSSKENIKDSNLKSSRLGKSITVKGNTFQSIQSAIDGAEAGDTIILSENMFKGDNYYGLGEQIYINKSLTIMGSSQFGSQYIILNALHSSRIFNITADNVTISNIQFTNGYVVGEPGGAIYWFGNNGKIINSYFSLNCANSSMEWDIEGGAIYFGLKFKNQYIENCLFKYNSAYDGGALYTCSQNTTISKCTFDSNFGISNNAGGMANGAALSFSAKDVYVIDSTFLNNDAPEGWGGAVYIYKHGYEPYFFNCSFKNNSAAFGGAICWLTDGGTFLNCTFENNHATGGDAIPHGGAIYKIGRNGGNIINSTFTRNYATTGSAIYLNAYLNIDNCTFTDNQADSEGAIYIITDNVTIRNCLFDKNYAYNYGAAIFSWDHDNIKVENSRFIENHARNEGGAIYFLGKNCQIYGCLFEGNRVSNFYSFGGAVFMEISGEDTSILDCSFKNNSALYKGGALYISYGSSEKIAIINSSFEDNSASNGGAIQADWNLSLIANSSFEDNSASYGGAIQVFGSVDLIANSSFEDNSASYGGAIHVFRSIGLIANSTFKNNYANSLEINQSKESYGRVFTFKGKENYINAIYTEDYSLNFENVTYWDGSFVTSGSPIKSDCEAGIKIRIVLRQGVSAGPVVLNITKITNIKGEVVFNEYNGLSPGIYYYEAYHPKDSYYSESEKLSGMITVPKKATDNTLAISLDDSIYGEDLKVNVNTDVSGEYRIYIANSNYDAIFTDDDVAKGNVLAYDITVNENELKGNKWTILKNSLNVKNGYGAYIQFADLEDGENYINIHNRTSFNVYKAESSIDANETIAIEGDGAEVNYTIENGTASIDNIRRGSAILEEGTDYNFTVTPDKIIITGLDMGNYTVKLKTIVDSNYNPSTKEVFICILGRTAIDVQESVAIEKDKSYLLSPTLIPEDAGTLRYISNDESIVKVDSKGNLTAISEGNTTIMVLFDGNDIYAPSNATVKVSVYSGSMPTSIKVNKSFELYMDESIDMGAVLDPANAGNLTYKSSNEKIVKVDNYGKITGLGQGKANITVSFSGNEKFLASNATALVTVYPLVDLKIAKSANVSGEVYIGDKIKFVITVSNNGPSNATGVYVNEALNSNLVLASNSTTKGNYDGSKWTIGNLNKGETVNLTIIANVKSVGNIDNKVIANSTERDSNYTNNIASISTIKALPIVDLSINVTSNKKSLNVGDTFTYTINLINLGPSKATNIIVDELLSQFIELVNVNLSIGNYDNSTSVWSVDQLDPNSPVSLNLTVKAIRAGKIENSVTAYSNEKDSNESNNNFTLSINCVKINTQLTANNITTSYNLNKDLIIGLNDSKGNPLSGFIVSVDLNGKKNYTTDSNGQIKIPTKSLIPDTYNATIRFEGNEKYYSSHASAIIVVKRASTSLNYTNMNTVAFDSNIEGRVGEYFQFQLLDNDGKPIAGKQVFIGFNGVKYNRTTNQTGEARLQINLKYANHYTFAIAFLGDNNYSGDFQVALINVTEQTPVLTTSPKTYKSTAKTKALTATLKSSRGQALAGKKITFTLNGKVYSGNTNSDGIATVNVSLSKKGTYSFTAQYGGDSTYKKVTKSSKLTIK

SEQ ID NO: 6829 - protein, 433 aa, Methanobrevibacter ruminantium
MEFERPRGTRDFLFEEMRERKMAEDTLRNVFENYGFGEVQTPLFEDLKLFTTKSGEEIVDQLYNFKDKGDRDLALRPEITAPIARLYLNELQKTSKPIKIYYYGSCFRYERPQKGRFRQFWQFGCELIGAKTPEGEAEVIAMCNNAIEELGITTAEFNVNHLGIIRGLFAHFDIDTATQREIMVVIDKGDKDLLKDSLVGENPIIKDKPELNEVLFKLMDMVGDSSIIKDIEELVAPYEETQEALEEFKELVKTLESFQVFNYKLNLGVARGLDYYTGIVFEVYVEGLGAQKQVCGGGTYNLVKLFGGEDVVSTGFALGFDRLMNAIEELNGKVELEPIVNTYVAAISDSTRHNAFSIAQDLRKANIPTEVDLSRKKFKKILAYANKIDVKYTVLVGERDLEEGKVTIKDMLTGEQELVAIDEVVDYIKGKLY

SEQ ID NO: 6830 - protein, 137 aa, Methanobrevibacter ruminantium
MELNFRLNMGGEDLVIAVAQDYETNDVLMVAFMNKEAVEQTLKTKKAHYYSTSRQKQWLKGESSGNVQTVKEMYIDCDADAIIMKVDQIGAACHEGYRSCFFRQLDIDKENIDLDSLTDEDISIISERLFDPKEMYG

SEQ ID NO: 6831 - protein, 720 aa, Methanobrevibacter ruminantium
MDFNDYDYDSEYNNDEEEYNDEIKRIVPDTSAIIEGNVEKIIKEKGLNYPEIIIPEAVIAELEHQANNQRPTGLRGLENLKKLQEMAEIGELSIRITGRRPTKFEKDNAKLGEIDGLIRDVAKDELALLITSDKIQAKTAEAQGIPVIYYAQEYKGSIDLKIAKFFDEETMSVHLKENVPPMAKKGKPGHIKLVKLADEKFTFKQLEFIAEEILEKERYDPKTYLEVDRQGAIVVQSRDLRISIARPPFAEALEITAVRPVAEVSLDEYHLSSQLIDRLTNSARGILISGSPGAGKSTFAQAIAKFYDEDLNKVVKTMESPRDLQVADTITQYAPLEGDMEKTADILLLVRPDFTIYDELRKNHDFSIFADMRLAGVGMIGVVHATKPIDAISRIANRVDLGTIPSIVDTTIYIENGEISAIYENKLTVKVPTGMEERDLARPVIEVRDFETGTLVNEIYTYGEQTIVMDIGMVEESKKAKDKEEKTPVQIIAEREILRTMKRIVPKAAMEVSMENDRRVNIYMSEKYIPKVIGKGGKRIAELEEDIGISMNIEPLDKAPDSFSERLSKRSKKKKSKKEKKKKSKKSGLKEYNGVEDGELSEDGLKDYNKDNYFDFTDDNEDYYEDYEDYDDSDILEDDYEELFYDTFEVFPKVRKSRVELPIGKKYVGKSFDIFIEDEFLFNATVSKKGNVKVHRKLKSYGKIVSALDAGDRIIAKVRK

SEQ ID NO: 6832 - protein, 255 aa, Methanobrevibacter ruminantium
MKLGASIFPRKIIPIEKSLDYFESNRYIEYMEIFHDYPNRDIDVEKDLIDKFNSYDLKYTVHAPFIEVNPASVNPALAKASVDEIKRSVDLANLLDSDIVVIHPGRAIFTNDMEYMASVYRIAEENLKVIGEYAKDNGVMTCIENLPRLRGFMYQDINQLNETLERTGLPMTLDIGHAYTAGFDVDDVSFDCISHIHIHDNDGIRDSHLPLGEGIIDFKRFFEIFDKYDGIYNFELGSKEYIEKSIDYLKGLKLI

SEQ ID NO: 6833 - protein, 257 aa, Methanobrevibacter ruminantium
MKIGASMLATEDKTMKESLDYFDSNKYIEYVEILHDYPYRELNDDKELIDLINSYDLKYTIHSPFIDLNIASLNSALAKLSVEEIKRSIDLANMIDSDIVVAHPGFVSFNGRGKEDIIYEIGREGLVEIGDYAKDNGVNACIENLPKIEGFMYQDVNQLNDTLVELELPMTLDIGHAHTAGFSPDEIYFDSVKHIHVHDNPGDDDTHLALGDGTFDVNGFFDVFTKNGYDGIYMLELNHIDFIQKTLDYMKNLGLID

SEQ ID NO: 6834 - protein, 433 aa, Methanobrevibacter ruminantium
MWNEEIETMPREDIYELQLKKLQSTVKRAFDKIPYYNKKYSEANVFPEDIETLEDIEKLPFLTKDDLRACYPFGMFAVDKKEIIEVHSSSGTTGKPVVSGYTQNDIDNWGEIVARGLTMMGLDSDDIIQNTHGYGLFTGGFGVHYGAHRLGATIIPISTGQTRRQVEIMADFGTTCLIFTPSYGIYLGEVAKEEGIDFDKLGLKAIGFGAEMWTAEMRDRIEETFKTKAYNIYGLTELMGPGVGIECSAQNGLHIAEDFFYPEIINPKTGETLAEGKHGELVLTNLERESMPIIRFRTKDLTALHYDTCKCGRTLARMERITGRSDDMIKVKGVAIFPSQIEKALLKVSNIEPHYQIIVTRPDIMDEIEIKVEASASLFSDDIKEMMAVKRKIGEYIQNETGIAVNVSLVAPKSIPRSTKGKIQRVIDKRNLH

SEQ ID NO: 6835 - protein, 144 aa, Methanobrevibacter ruminantium
MYKITQLSIFLENRRGKLYNTLNLLAKNDINIRALFLADTTEFGILRLVVQDPIKAKDILEENDHIVKMTPIIGAELDDTPGGLSTVLKIIKDEEIDLEYLYAFTHEKTEKAILLLQADDLDNLIGILTAYKVPLVPAEEVYNL

SEQ ID NO: 6836 - protein, 316 aa, Methanobrevibacter ruminantium
MVKVCIIGVTGVIGKNVAFKLARADTVDEIVFFTREKSLSKAKGEIYDMYDALAAEDIDCKLTPTSDYKDMAGSQIILITAGAPRKEGMERSDLAHTNAQIVYNYAKQIAIHAPDSIILIATNPVDVMTAVALEASGFNKKRVIGLGNHLDSLRLKTYFARRLDINSSEVHTRVVGEHGERMVPLLSSTTIGGIPLKYFIKDVKLDLPDIVKTLRNAGNTIISKKGATEYGPAYAISNLITTIITNIHKILTVSMYLEGEIADVEGVCLGVPVVLSKKGAAMIVPIHMNDYEVNKFQIAANHVRELTNEVLERLEK

SEQ ID NO: 6837 - protein, 834 aa, Methanobrevibacter ruminantium
MYKDAILVRGAKVHNLKNIDVDIPLGKIVAIAGVSGSGKSSLALGVLYAEGSRRYLEALSTYTRRRITQSEKANVESVQYVPAALALHQRPNVPNIRSTFGTSTELLNSLRLLYSRCGSYICPNGHILKPSLNVAREIELECDVCGERFYGLGAEEYAFNSDGACPNCSGTGIERVIDDSTLVPNENKTLEEGAVESWNMFGINWMYHVAGELGVRVDVPFKDLSDKEKEIVYKGPSVKRYINIPSKNGKLFELNAEYRNAHRAVEEALKNAKTEKGLTRINKYLKIRECSQCHGTRLNKRANSTLLGGINISQACQMTLEDIVKWIPNVINNLPKEMQDMANNIAEEFMDNAKILLDLGLSYISLDRPSNTLSTGELQRVQLARTLRNPTTGVLYVLDEPSIGLHPANVEGLIKVMNRLIEDGNSIILVDHDVRILRIADYLIELGPSAGSNGGKIIAEGTIDEINKNKESLISGFLSNEEKIIIRKKSDKNSIFKNGSIDISTCQIHNVKPMDISFPKGKLTVVSGVSGSGKTTLLLESLYPAVKSLINDENIPNNIKSIDAKNINKIELIDSVPIGKNVRSTVSTYSGVLDDLRKIFAKLDSSIERNLKASDFSYNTGSLRCPSCNGTGTISMDVQFLPDVEITCPDCNGLRYSDEAGEIMLGHLSISDIMALTIDEAIDELSNIEDESIDPLLKRAINKLAKLSNLGLGYLTIGESTPSLSGGEAQRLKLASEIGKSQRNSIFIFDEPSIGLHPLDVKVLLNVFQTLIDDGATIIVIEHDLDIIANADYIIDIGIDDKHMGGEILAKGTLEDILNSKDSLTANYLNEINL

SEQ ID NO: 6838 - protein, 165 aa, Methanobrevibacter ruminantium
MVNEKMEAALNAQLNAEVYSGYLYLSMAAYFEDVDLAGFANWMRVQAAEELEHGMKFYDYLIRRGASVTLTAIDAPQTEWESPLAAFEHVLEHEKMVTGLINDLVDLAIEEKDHATNNFLQWFVEEQVEEEENAMENLAKLKLAGDDNSLLYKLNEEFAGRGAAE

SEQ ID NO: 6839 - protein, 51 aa, Methanobrevibacter ruminantium
MVFVCDICGYEYNPEAGDPDNGIEPGTAFADLPDDWTCPLCGAEKADFVEE

SEQ ID NO: 6840 - protein, 52 aa, Methanobrevibacter ruminantium
MAQHRCTICGYVYDSETGEERRDLAAGTEWEDVPDDFTCPLCGAVKTMFRAQ

SEQ ID NO: 6841 - protein, 205 aa, Methanobrevibacter ruminantium
MISLKTIVINAGPKKRGFNAEMAKSALRGAQSVGAEVEFIDLYRLKFTGCLSCLICMRDDFESCKCFLRDDLSPLIDRILDADCLLIAAPIFFSNPSSHYMALLERLIFCIVSNKGENLFKGKVNVGLIYTFHYDKGYFEESVRPHFKHSEDILKMLNGEVEIYSAEYDSKKTYSTSFDGEISSEDECFTLNLEKTYEIGAKLSN

SEQ ID NO: 6842 - protein, 136 aa, Methanobrevibacter ruminantium
MFKNILVASDGSKCGDKAVDIAIDLASKYDARVAALYIMDFGLDLSYDDMDDAGGAVLDDITAKGKEKDVVVVEHIITADPIQDMETMIRKINPDIAIFGAFGKSTDKEDKIRYDKIGRVALNALKVAKVPVLLVK

SEQ ID NO: 6843 - protein, 573 aa, Methanobrevibacter ruminantium
MISIKNLSKSYKLENGEELPALKNINLEVEDGEILGIIGTSGSGKTTLLRILRGVEKFDEGEFTIGRYTIKPDSSQFYYNQVKKETAIHLQRSFGIWPESVLDNVVRKLYGAKYGDESGTDFEIAHDQFDKEAMEIIELVGLEHKADHLASVLSGGEKQRLIMARQLAKKPAVMLLDEPATMACPKTKQEILDAIKKINDELGITVILVSHLPEIHKFLADRVVLMEDGEIVKDGDVNEVVDEFLKDIEEPVDIDIESTDETIIKAIDIDKRFYLLKGKNVLHMKDVNLEVNRGNVLSLVGPSGAGKTVLLRMLGGLDYPDSGDVLFKLVNKEDGEEEIRWVNIENASLDRMEIRRNLGFMHQEFALMYYATIQSQLAVKLGYKRWDMVEEAKKRAKENGLPDILLDALYQLTDLPEREAKARLEQIGLDPTILDELFPKFPETQIKEEVKDLFEALDLPLDILPRRSYELSGGQKVRAMLALVLVSKPDILLLDEPFGDLDPKTLRIVANSLKRICKEFGTTLVMVSHNTDFIKELSNRAVFIDQGHLKDDSEDVDKLVDDFIGFCKADYLM

SEQ ID NO: 6844 - protein, 351 aa, Methanobrevibacter ruminantium
MGMKNLILSKSDQFNHYKDKANQLKKENKELKLKNEELEFKNNELSPELEEGISLIIPSYKGENHIQPLLESLEKQTISKDLFEVIFIVNGEMDSTIDILTDFAKSNPDMNIIISYTSEGGVSNARNIGIRIAKREYIGFLDDDDFISDNYLKALYDHIAPNRVVLSNFIDIDEETGEEIGSRLVPYSMNREGIFNDVVVKLTNLSIITTAKIIPALAVKGTDFNPNLNNGVDVSYYARLYPKNHFEFYFVSKEEGAVYYRIRRSGSISRQETSYQFNVLDRLKVIDDINESYKQVDKSDELYVHFLKILFDAQTYFIGLYLDEYPQDREKVIEEVRKHNFEYFSYEKLEG

SEQ ID NO: 6845 - protein, 213 aa, Methanobrevibacter ruminantium
MSFSLESIGIKAGGRYETIYTTMNKAGEMDAAPIGLKYIGDYDVAARIFEGSKTLKNIQETGIFVVNITNDPSVFARSLYDNLKEEEFVKDDDIVYLKNADAYFIALVKSIEEMKPEHDHVNEGAKNYIIKAEPLKIIINRQGAKALNRGLFAFLESLVDYTRVDIIDDEKKEEYKKRFIENERVIQRVAEDDVKENMAILKEKMIEKGLDLE

SEQ ID NO: 6846 - protein, 372 aa, Methanobrevibacter ruminantium
MYNENVASKTKKILDSALDGPISVEDGNYLMNLKGSEIFPLLATADAIREKVVGDNVTFINNCNINFTNICKVRCGFCAFGKDADDPDAYHLSDEEILKKAEGAVRTGAREFTLMGGVLEDADIEYYEHLLKLLKSEYPDIEIHGFSPMMIKDAALKSEMPIEEAFKILKKAGLGTLPGTAAEILTDRSREIICPKKVTTQEWIDIIKTAHNAGITGSATMMYGHIETMEERVEHLDILRNIQLETGGFNEFIPMTFMHEYSPIFLEGQENLGATGTQDLKLYAVSRLMFHDIIPNIQVSWVKMGFRFAQVSLLAGANDLGGTLGGDELSEASGAPDGVDASIKDLSRLVRDLGRVPLERNSEYTEFYPIEL

SEQ ID NO: 6847 - protein, 178 aa, Methanobrevibacter ruminantium
MKRKNRGLLIGRMQPVHNGHIEVIKETLEEVDEIIIGIGSAQLSHELKDPFTAGERVLMMRNALIEEGIDLNKTYIIPIEDINRNKLWVSQVEMVSPPFKKVYSGNSLVQVLFSEEGYEVIAPELFDRKVLSGTEIRKRILMDEDWQSLVPKATVEIIEEINGVDRIKHLNKKEISEL

SEQ ID NO: 6848 - protein, 145 aa, Methanobrevibacter ruminantium
MVIKIVEKDDEYFTIGDLIEEIKKSDRVDEAGAIYSFEGIVRGEEENLTVDKLTLTLPDKEKGLEQIESIVETAKVKHGVFEISVIHFIGEFYTGDQLFLVVVLGPHRGETLEALTEVVERVKHEIDFKKEELSNQGTKIIMAGG

SEQ ID NO: 6849 - protein, 68 aa, Methanobrevibacter ruminantium
MAISARNGIKGTVESVKLGKVMASIKIKVEDPALITAVITKESAEDLDLAVGDDVSAIIKSTQVMVAK

SEQ ID NO: 6850 - protein, 68 aa, Methanobrevibacter ruminantium
MAISARNGLKGKIEDVKLGEVMASIKIAVDEPAVITAVITRESAEELSLAEGDEVSAVIKSTEIMVEK

SEQ ID NO: 6851 - protein, 68 aa, Methanobrevibacter ruminantium
MAISARNGIKGTVESVKLGEVMASIKIKVEDPALITAAITAESAEELELAVGDEVKAIIKSTEIMVAK

SEQ ID NO: 6852 - protein, 68 aa, Methanobrevibacter ruminantium
MAISARNGLKGKIEDVKLGAVMASIKIAVDEPAVITAVITRESAEELALAEGDEVSAVIKSTEIMVEK

SEQ ID NO: 6853 - protein, 68 aa, Methanobrevibacter ruminantium
MVISARNGLTGKIDSIKLGEVMASIKIAVDEPAIITAIITKESAEDLGLAEGDKVKAIIKSTNIMVEK

SEQ ID NO: 6854 - protein, 407 aa, Methanobrevibacter ruminantium
MSANKKFIRDSIHGNLPLNSFELEILDYPQLQRLRRVKQLGFIYLIYPGANHSRFEHSIGTMHLASKLADQLELNDDDKDLVRIAGLLHDAGHGPFSHVSEAVFDVPHEELTAFVVKNTSLADKLSEKFNTSEIIDIINGKGKLGPIISGELDMDRMDYLIRDSHYTGVAYGVIDTERIISNLKLERELILDIKGVQAAEAALVARYLMYPSVYQHHTTRIVNAMFRRCLRHMIHQDILNPKEMYKYDDADMISMCRNSEGFSRDIMERIDNRRLLKVAKSIPVNRFENPDKIFKISKEELLKAEEEISQDFNIDRNYLIINLPEYPRFDEMKTWVSFGDKLYHLNEISSIVGALSSARFNSPDICLYVPKEDLEKTKRIKLENYLDLPEEVRRYDTIHFNQSKLFD

SEQ ID NO: 6855 - protein, 184 aa, Methanobrevibacter ruminantium
MIIIAITGASGVIYGVELLKALKQLKIETGLLISNPAKIVIEYELEESVEEIKSLADHYFESEEIDSSVNSGSFKFDSAVIIPCSMKTVSAIANGYASNSITRLADVALKERRTLVLVPRETPLRDVHLENMLRISKEGGIILPAMPAFYHDPKDISDMTNFIVGKVLDVLKIDNDMFKRWEKE

SEQ ID NO: 6856 - protein, 187 aa, Methanobrevibacter ruminantium
MIKDFDFINTCDISGFIKEEIRAIALYKSDVSKEDIVLDINCGIGEISTEFSKLSKEVYCIDEDNTAIEFSKTNIEKHGDIDKVKFINQDPLSAIRSIIDFDIAIIKANDDNIGEIIEEIHNRINSKGRIIILTNILDFALMSVNKLDELLYNPTISQIDVSKGQQLNKGVKLISDNPMTMIYVKKR

SEQ ID NO: 6857 - protein, 232 aa, Methanobrevibacter ruminantium
MDILNKFDIVPNDMELYETAFTHSSYASKHHLNDYERLEFLGDSVLNMLTSEFLQNMHPDFGEGKLTKLRANYVCQNALIVYSHEFGLDKCVKLNLEDNALTDNEVISITADVFESFLGAIYLDQGISKCKEFLTITVFPYIENEQIFFHDYKSTIKEYGDAIDKEITYELIEEHGAPHDKTFVMKILIDGVDFGHGVGKSKKEAEQVAACNAIKTLRLDHGQDVAYMRLYK

SEQ ID NO: 6858 - protein, 152 aa, Methanobrevibacter ruminantium
MLLNWCEEITNIDPSINFRATGGWLKTVTGLDKSVLNGYSLVGEFVKSGDYKHEYSDGLYLDCNKEGKKSKPKQDFRLFRLKNGKLTLIDQVYDGKKNWACEFWESVSEELNPNFRESEADKIISLILDKTGKDKKLLREVQSQLDLVISEI

SEQ ID NO: 6859 - protein, 170 aa, Methanobrevibacter ruminantium
MTKSLILYFSRAGENYTSQGIKNIEIGNTEVIANYIKEFTEADMFKMEPLNDYPEDYMQCTEVAQKELNDDARPELKEYIEDISEYDMIYLGFPNWWNTMPMPVWTQLEKLDFDGKTIKPFVTHEGSGFGKSEKDIKNLCPGVKLAKGLSIRGSSVEDSKKKVKHWVKKG

SEQ ID NO: 6860 - protein, 61 aa, Methanobrevibacter ruminantium
MKGTPSMGKKNKKTHIRCRRCGKNSYHVRKKVCASCGFGRSSRLRSYSWQNKKSTTRQRLV

SEQ ID NO: 6861 - protein, 77 aa, Methanobrevibacter ruminantium
MSGQQNVQRPLDALGKAVNSPVLIKLKGEREFRGILKSFDLHMNLVLDDAEELEKGEVLRRLGTVLIRGDNIVYISP

SEQ ID NO: 6862 - protein, 234 aa, Methanobrevibacter ruminantium
MVELRVNAGNVKNPNVHKIGIIALGSHLENHGPALPIDTDAKIASHIAFQASLESGAKFLGVIYPAHELKEINHGIHVSLEDLTDEIVKVLKSAKKFLRISSVIIVNGHGGNLPIVTTLYDIEERTGLLITLNSKIIESEGPHGGSGELSMAKALGIIDESQVENQTNLEEYGEVGLYMFGEARRNDPNIEEGALDVEENGVYVDDVYGQELLKLAINSVLLDVEKQLDSHYGY

SEQ ID NO: 6863 - protein, 181 aa, Methanobrevibacter ruminantium
MIKLIKIIDFFNLNLLNGFKVLILKIKKRYFLKKKKVKEIKSELGDYGSFINNKDTLEMLEAEDYNFILVNGEPYIIIINDKPYPTLKAALNMELDSKVVVVDMGAVRFVTKGADIMSPGIVDADESIVPDDIVIIVEETHNKPLAIGISLITGPEMVENSEGKAIKSIHYVGDAIWNLEV

SEQ ID NO: 6864 - protein, 149 aa, Methanobrevibacter ruminantium
MVNDEKSLSRMSKTDYYLAIAFAVSKRSTCLKRHYGAVIVNNDEIISTGYNGNPRGEENCCDRGSCKRMDVPSNSGDYSDCFSVHAEQNAMISASRNEMIGATIYLAGEMFKDDSWFEIEDAEPCPICFRMIKNSGVKKIVSKGVVIDL

SEQ ID NO: 6865 - protein, 807 aa, Methanobrevibacter ruminantium
MEGEQNNLRPYIEDFFRDLQLYDDYKNGHHYKDLLEGSIILFLEKENTYTAYEIYENFFMIYQITDEDKSHGHKTESIDISESNSLLKLVNVMKDYEENTGDLIEKQRDHFIHSVNVFILGLAIYASNHKYRNAFEAYVTDSPYKKYYKTADGEFSAEEFLYRWGIASLFHDIGYPVEIIGKQLSKFINDSSQSISQKYKVNTAVNFKNFNELNSIIKLDPKFPIIYRMDYPETNFIDVYKPTNLMAHQIFTDLYVDSDIRAIDEFDELNEYLYKLVVHLDGFVDYMTSNNFIDHGFFSSIFVLNSYGAIMQKHYLNDDEEKFDYYINKYAYFFYPVLNSATSILLHNYFRGTLNEKESKTDEFNLGKLEPMQNPLAFLLIFCDELQEWNRRPIGLKDKAKNHVHDIKININENQVLVDYIVKNSALGLNFSENKEELINNLLDVTSIFSNGLKVNITPYLDEKYPLEDISLSEVETPRILLRHVEEIARASHNRYNEIGKAHGNPDEPYESLSPKRKLSSIRQTKEFPMKLNLIGCEMVSENDPRDEYSLSDDELDFLAEREHEAWCREKRNVGYISHHDAFKRGLIDDAEYDRLCRTNEEGCETNKHNKIESPERNLYVHSNIIPYDELNQYSKNKDRRPFEDLPDNLKLIKNNPLKIVENRYKLFTVAMHNEYMDYIAGKKEVPEFKDLPFELQQINYKQTYLIAKYLNEIGYEIVEKDDERPAVTKFENNKETGYLAGREHNAWYLRKLNDGCTNGKNKDGTDNPRINPWDELDYSLKKPNMNTFKKLPKLCLKADLKIIKNK

SEQ ID NO: 6866 - protein, 264 aa, Methanobrevibacter ruminantium
MNDKLIELPNYGRLMVVSDLHGNLNDYEKYIDLWDCQDPDFHIVFLGDLIHSPYFNDKSVELLDDVIEKDKKYSNFHVLLGNHEWAHIVHRDIFKNGENIREDFEYLISYKKGTIEPAITEYIRFFKSMPFFVKTENGLFLSHAGPSRKVKSIEDFNGIFDGDYHNPILDDFLWLRPKRNLYGRRNILTDSNLYDEGDIFNFLNIVGANCMVVGHSPVDGYKQYGNQLIISSSFQTEDKVYLDIDLSKEIKHMRDLLDCIRYFD

SEQ ID NO: 6867 - protein, 84 aa, Methanobrevibacter ruminantium
MEEIIQTLKEIEKENNIEILYAIESGSRAWGFSNEESDYDIRFIFKRPIKDYISLKNNKDALDITIDDYDIVGWDIKKDFKPPL

SEQ ID NO: 6868 - protein, 147 aa, Methanobrevibacter ruminantium
MGNCDFLNELPDFDKDVLKYHYASIAFNVWKEALDREEMDRKSTKRYLYCIRCILAWKSADLGKDSSISIFELMEDSEINDDLKSDINTLIDYYKSLCKNELDEELIDRLSIWIDDTVKNIKDHYPKKEKKDMSLYDDVLFKVLEIE

SEQ ID NO: 6869 - protein, 277 aa, Methanobrevibacter ruminantium
MGFKEDNKDKYLDPFKRVTVDVGSSFNRINVSADVIGNRIRITVPKDKSGNLTGTIVENIALENSTWIFEPVADEIMEDRIDRKLSPRKYMDLSKFDFERGFLPKEILDDLVYPINYRKDYSPFAKKVLEHPNDEIRKIALGYIDDEDVLASIILFSKDKDLSLFVLEHIKDKSILLDIVRNDFNYYYFTGAVDIFYDMDKLPLKLFDLDIRKAALERIDDKELLFDLAFDCEEWFKPIDMIKDNNLLSKKELDSLNLYAQNREIREIIKSRLKNEL

SEQ ID NO: 6870 - protein, 579 aa, Methanobrevibacter ruminantium
MCGIVGCILKDKQKSVAPILLECVENLDYRGYDSVGIATFDGSIHVKKDKGKIPEVDEKLDLADMPGNFGIAHVRWPSTGIASKENAHPQLDESDSIAVVHNGSLKNYDELKGELIADGFKFKSTTDTEVIPHLIRKYMNEGLDLEHAFRKTIERLDGSYAIAVISKEESNKILATRYQSPLKIGISDDAYFISSDIPAIINYTRKIILPAEGEMVILDEDGVHVHDEDGNEIEKEILVIPWTAQMASKGDHPYYMIKEILEQPDAVEFTLGERENIQRIVDDLGDIKNICFVACGTSYHASLTGKYLLQHLAKIKTDVVLASEFKYTADTLDKDTLVVFISQSGETLDSMNALRIAKETSPTLAIVNNIGSSMTEEAKYTIITQAGPEKGVAATKTYIAQLTAIYLFAGLLANDEKLINELYNVPGYIREVLKKSSEIEVLSKRYSFADDLFYLGRGFSYPIALEGALKLKEISLIHAEGYASGELKHGPLALINHKIPVIVILPPGSDYEDTMVNLEEVKARKAIILSICAEGDAKAECKSRDVFTVNSKVSETIAPLVYTVPLQLLAYYVTLEKVA

SEQ ID NO: 6871 - protein, 1034 aa, Methanobrevibacter ruminantium
MIANSPKEIKSRLIEIYNEELLNLNIFIKNRDELKGNKDLRYLLLERIKEEFDYLDDEELFILLSFYQTIPSFYRKTFNKILEASIDKNYIEIQDELLKLVEIIKEEISNIDGAIEEQNLKIEEKLLKSLYSKDNQNGENSDINHLNEGKSLDINNLTDEEILELYNISDEEFSQLQDYYEWEIFESDFLNEEILEDYDESAFLDIAYNHKDAEVRGFALGMVLKPYVWLDFLFNDPDLFVRKSALFYLFKERYLNDIEDIDYLGKIPIEIDFNLDYSDAIDDFKIDESLFNRHDKIIISEISIKDDDLIVKTDPKNSYEHAVSKIRSQDALKAIANYHNQWSVRYIAVNKITDIDYLYDIALNGFNKDAKPRHGILYYPGEISEGDVLKSLLNRLLRLKNLSDEDSQSFLKELFYKSKDSIIKRYCLSKIEDDVFLVNLANTEANPSFARVCLDTIKDEDYLILLSIAIITNPRFKGKNQDLYDGLCEGGIGDEDSFIRESQFDEIDYHNIRAYASKILIALPRKTLNETLESFSLKLDIPNLKEHRVFKPIINKRITDILGDLAKIDESPLVRSIAVLGLEDTNDLMSIALDDEDDKVSFNAIKKLNDDNFIEYYLKETNRKAYYLVEGNLVKDQSLLKKIALNDSWGPTRSEAVRNIKDEDLLIGIAKNDPEAIVRREAVLKIKNQSALIDIAYEDEDDLVRDFAISNIDDEDVLEDLIYKNEDSNILRTILSKLDNEEIIKDFAYNHPRGIVRNAAISNIDDNRVLVDIAKTDEDWTVRRNIIARLVGKFIKSSVDVYEDKYLNHLKRREYYNSLIKGDNEKFKSENKVKSSENEKNEYADASSIVLYEDDEPYTLQDLLVDRALNDESEKVRAFVVSYIDDEYFLFYIVSNDKSIKVQLSAIDGIKRNELLAKIFIKSKNHHVYRKAISRIRYEYILLKLVCLKNYYGELWPKRQMAEARMEELGFKSPLIKKEDNRKNKFFRPIFDIRDYQRDLELLDRLDKEYKNRSNNSDDSDGSSDDFQFKRIVF

SEQ ID NO: 6872 - protein, 153 aa, Methanobrevibacter ruminantium
MKLMFVCTGNTCRSVMAEYLFKTMISGDIEISSAGIMAKDGSSPSLNTIDVCKKHGLDVSNHKATNVKRSNIKDMDLVLTLEESHRNTLLNMYPNLSIYTIKEFNDVDYVYDIEDPYNQSLEVYEATFNEIKESLEKIDPDKLLSYGFNVEKD

SEQ ID NO: 6873 - protein, 126 aa, Methanobrevibacter ruminantium
MIMDNMWIEALKNKYRFEFKGLINVEDLFDLKLEDLDYIYKNLKRDENDLQVDSLLDANKNPLKGELDCKINIVKSIFQMKVAEIEKAKIAMANKAQKEKILAIIENKQDQELSEKSIEELRKNLR

SEQ ID NO: 6874 - protein, 670 aa, Methanobrevibacter ruminantium
MRDRLFNHFNENMAPRKLFIVDRDWEELWNMYLDGFPREMNPIYRERRELDCSACRSFFKRMANVVALDEDTGDFISLFAGETNGEKEVFRALDEYVKSAKIKDVFMSDTQRVGIESNHEMLDSGSVHTWYHFYVDVPSEYVGNLSQKAIYRNNRIVLENSTQRISQDAVDTVLELIASNSLYRGDQWEDALKSFKDYLKEYEANDMDEDLFYWIKSIELGSLLVRIKNHSIGVLLMDVTQGVPLDEAVSNYERIVAPTNYQRPKPIFSKRMLEDAQEKINELGFGESIYRRYANMADLSINDVLFANRDYTSEIQDNQNFFDKLKELTVNRARNFDKVQEISLEDFVESILPTALEVELYLSYDLSNNFMSLIAPVNRDAPSMFKWDNPFSWAYKNNIADSLMKERVKALGGDVDVDLRFTIQWNDNEWDKNDLDAHCTTPEGEEIYFSHMRSSKTGGWLDVDIINPEKNVPAVENIQFKDRNQMIPGDYLFRVHQYTYRGGDDGFKAEIEFDGRIFNFIYPMRLYQNEYVDVAKVSLGEDGNFTLNSFLDNQTASAKEWNLNYNRFVPVSLICYSPNYWGDNAVGNKHIFFILKDCLNDGRPNPWFNEYLVSELRDHRKVTEALATIAKVEESDEQLSGIGFSFTQKNKVTLKVKSENIERVFNVVIG

SEQ ID NO: 6875 - protein, 394 aa, Methanobrevibacter ruminantium
MGTLPLGNDNDLDDSQFYNRAEEISFISENLELTKKGSTPTILLTGIRGVGKTALMKKLKKDFQKDGYIVVYMELSGMNKYKKDSLDRFCFMKLFYESIINAYKESNILSINTQILKYIKTRNFKIDKISSFEKIPIPIITTEEDYSKFAGFVMDLPQMIYDDFKDEINGVLIFMDEFQILKQLDEDVNGFLWYIRSIIQSQKNIGYIFSGSMSLKDDLIADIAGQKGAFGGRILNYEIKRFSYETTKNYLNEKADYLNFTEEGFERFYHCTKGNLYYVNSFARLLPPNIELNEEKVNSEFDKSLPYLVIHLSSEWYKLSNQEQRIVIALIEGPLKRIEIANKLQVTSGAIGSSLKTLQNKMLIEMDNNKYQIYDSIFKAWLKKEYREKGDYPF

SEQ ID NO: 6876 - protein, 731 aa, Methanobrevibacter ruminantium
MSRRDKMIAKIKELMYKPEYIRNIGICAHIDHGKTTLSDNLLAGAGLISEDLAGEALGMDTKKDEQERGITIDAANASMVQEYEGEQYLINLIDTPGHVDFGGDVTRAMRAVDGAVVVVCAVDGVMPQTETVLKQALRENVKPVLFINKVDRLINELKLGPEELLKQLTSIIVEVNALIKSLAPKDKKNEWMVNVEEGSVAFGSAFKNWAINIPKMQETKFTFKDIIDYCNEGKEDELKQLLPLTEVLLNMVVKHLPSPNVAQVYRVPKIWDGDIESEVGQTMIKMSPDGPLAGMITNVAVDKHAGIVATCRIYGGTLEKSSEIYLVGSHGKARVQQAGIFMGAETIDTGKVPVGNIAYLTGVKGASAGETICSADCIIDEFEPIDHISEPVVTVAVEAKNTKDLPKLIEVLRQVSKEDPTIKVEINETTGEQLISGMGELHLEVVTNRIINDKKLEILVSEPIIVYKESVLGHSPVIEGKSPNKHNRFYIDVQPLDKPLYDALIEGDLKEGRIKTKETAQDFIELGMDKEEARRVWDVYNRSMFINMTRGIQYLDEVKELLLEGFEAALKDGPLANEEAVGLKFILSDAKLHEDAVHRGPAQVLPAIKKAIYASIMSANPCLLEPIQKVFISAPLEYMGNCNKDIQNRRGRIIGQETKGVIAEMDFEVPIAKMFGFAGDIRSATGGKGDFSTEMKGFETLPIYLQDDIVRQIRTRKGLSPEPYGPEHYSA

SEQ ID NO: 6877 - protein, 661 aa, Methanobrevibacter ruminantium
MTIPVMYDLDEERLRALNKDEKKEDRLFSISLLNPFYPLDSLVTDEEEDLDIRIAALDCLDLFGVTLYHIDIDSVPKELALAVIEMLDDGSKLKEIALNHNDIDYRIKALENKHLTDEDALKYIIENESAPKLRSLAACHPCLNDSKFLEGLALNDDDEDVRAAAVSNYSTKGVDVLKKVISDDEDIVRIPALKNLVFKYNLFNPSLNKKFNFKKKFHDMSWHMISSIDDYVPKEMDNDEGIRDLIDFELLDQIYISSANECYNELIDKLKIFFEKALYHYEIHNPFDESKLENDSYRKKMYDKLKLAEGDQRSFYLYQMAYDGGHAYLNFYLDYLNGLDYDSYLGDSDSSNEDSDLKKLFNESNDSYSLDKEIEESYFIDLAYADSNCEMVRLAIEAISDNSVLFDFAKNGKTSDIRKTAIKRLTDSAYLLDLAVNQIDKDIREANFYDDDWICDYISDNSNDYFDIFNTYDFYSHDLEHYERLFDNRLDSFYYEKVAWNYYRNTISFCLLERIDNYLDLVYAIKNTRSFVLRDLVIYKIENPLFLTDIALNAIDERIRYTAFGRIESKAFLKYVYLNSNDFRIKLLYLSKTTDNAILEEAFLNEENDVLRKYVLDNSNFKISPKVIEHCINEESVISDYAENKFAEQFVNYRLMDKKFL

SEQ ID NO: 6878 - protein, 123 aa, Methanobrevibacter ruminantium
MGFIMIINKLFNMNEDNEIYLVIILVLAPLIFSIIDFTSCLVDHGVITWFNCYTFKTYICFIPILLICSIIAKVIWREKSLKDVLEIAFAPLFFWLIEIGFALFVSLFIGVFIDMIIGIEAMV

SEQ ID NO: 6879 - protein, 158 aa, Methanobrevibacter ruminantium
MANWCENKLTVKGTSEELVKLIEEHVIDGELSYKTFATEHRLFGENHFDLDEILNERISEIVFWFSTKWSPVPAEKVCEEINQTYPTLKAELSFFSAESGFWGQYSDYGGEEYYELKEEDIEKTSEEFFKFGLEEGFLEKTESGKYAFTHDVPTFRLL

SEQ ID NO: 6880 - protein, 1587 aa, Methanobrevibacter ruminantium
MSLMEWKYATIFISSSFIDMHAERDYLIKKVFPELEEWCEEHKIHLSNIDLRWGVPEEISNNKSTIEKCLINIDESRPFFLCFLAQRRGWIPDFAEDISDDTFKRYEEIAAYSGLSATEMEIEHALLSPLKDFLNDDDELPENLRTRHSLFFIRDKSSLDEITDAQKRVYTNYGLVDAEHGEFIPGEYDSEGNCIREPKIIDDLSLKTKEIIEDADNSSQKIVDRIIKMKGDCDLPEDEKKVHIEITKYTGDWNRNLKIPEIEALTNKDKDDPEKKVRRYNDYEWMGRLSNFKEVKEDYKDISLIKKSENIESKIGRPLKDVIIEQMKRQLELEFPENFKEDEDLTEEERILQNELNQQDNFAYLNSQGYIPIKKDTDILSKYIEDADESRICLVSSEAGFGKTMLLANLAIQLEKKYTNKYDETRPNQKAIYKRFCGASNLSSKAFSLWDTIIQEAGLTEDDDFKIPKNLDELKKSIDKILDKISQKGESVIIIDAVNQMPDGLEMLKWLPAPESSNLKIIISCKEDNEDKELCLESLKFIKDRNAICPYFEDGHEDELGGEYKNYSFELKALEDCKNEKTKIINAYLKNYLKELSNKDIETICSFDASKNPLFLKVLLAELRVFASFEKLRDEIQEFIKDEFADESKLTSEDSSNHSDDSEGSKKQSQGSPKTAFNHVLERLEHDEDLVEGEALVPLIFALLANARVGLSRDEMASIIKAAKPDLDDEYIRDTINLNLRQVKPFMARKEGRDDFFYESFKLAAQERYAPKNIPKNERLNEYFKDKEDSDKLINVNALLADYFLKDALGQDSADSNDKTLDLSTIDGFNFKGENIRSYNELPYHANESRDFDRLKDILSSYSFIKNKINLSDINNLIVDYQFKDFEDAQHPFIKDEEDHSIVLIGRALELSAPILSDDKSELPAQLYGRMVDLRDDEVISPLIDEIEADYEMVLKPKSNSLYSPKSSIIKRPKVNGTKSTSSIEITDDKLLISANEDGTLNLFDLESNDLEILEEPHDSKVIRIIPTDEGQNMLMASSNGQINKWDINNRSIFKDDDNIYPKINANITDIYLSGTYNKIYASSHEGIFTIDLDTKELCEEKEIEHKKYNQILVPRRNEAILVCDEKEVDGWDVYEKRKAYNRQHQQNPAGEESSTQLDSSEEIRFMGLNKRFLTLISENGQMKFWNTLKNSGGGESIDEAQVCSPHDKFAQAITLEKEDQIITISDMGVLRVWNIPRPRQPKFEIAKIEGSDIPMDIQTGIKSPTAIDYFTDGDERWVIVANENNDISVIDLNKKVEANKETKHSESVLSIKIDGNHMITASDNGEIFAWDLNKEECINKFASEFRVNSISYDRDKSQLLLSGVKKEKDGNKIYKIASRDATDMWEPIKVQDDGSDSKKSKKLIDLNADDRDNPNPVIDIAQISDGMVFIEEKKISMPDYEAGFDKKATSLATQFDSNLAFVGFEDGSISSYPRETEFDAGINSPVVKIRVSGDRLVAGFKDGSVVIFDLSGTKTASFKAHDKAITNIYLDESRLITISEDKTLKFWKNDECTYTYFLDIFATSVSVNDGKLILGDTLGNLRFFEL

SEQ ID NO: 6881 - protein, 761 aa, Methanobrevibacter ruminantium
MMRQIRRNTIDFAIDLGTSDSVIACFNGQESEIIKNHSTGEDHTPSAVYIDSLGEIHVGRIAKEAVLKCPSNATSEFKLNMGFPIPFLFESSQIKMYPEQLSAELLKDLRKSIYHQTNQNIEEIVITVPANSNPLKTKATKEAAELAGFKSVYLILEPVAAAIAYGLRAKKEDTGIWMIYDLGGGTFDVSLVKANGQEIEKLATSGEDNLGGKLFDWKIVDDYFTPKIIDDLNLTDFRRDNPNYLKVFSILKNEAEKAKIALSGSDNDIKDYELSIEKLIEIGDKSYDFNYILGKEDLMNIMKPFLKITFNHCYEVLEESNLSIDDVEKIILVGGSTLSSILRDSLKDEFDRPLEYGINPLTVVAQGASIYAGTIEKQFIECENHRFALILDYEKIGFKDNIDINGKVFALDEKYSFLDYSIEITGSNGEIIYIEDSKTGNPTERIDLDIDGNFRLNLNVKDSYNEFLINIYDGNGDLVELDENSPNSIHYKKALNPGYPILSSSISLYLDEDSSLILKNSEDLIDLDTENDFIIEYSKRFNSSYPIASKGDIIPMSRKEILHTSKIIKKGDGDSFIKFSFYFGELILANYNTLLGQIVITGNDIIDDLPKDSEIELNININESNMIDFEVFIPYLRQSFNNSFSFNNYNNYNGFIDNYDNLKSKHDEIIKKYNKIRDFARDEDKKELFLKNGIYQSIERVYENIEEIEEKEIIDYLDILVDMARYDKIAVYPSLEYLNYLDDVLDECKFFLTIADVELSI

SEQ ID NO: 6882 - protein, 552 aa, Methanobrevibacter ruminantium
MVLLNYNQTKDMIEDYFHGQYEVLKFLGEGSFAQVFLVKQNFLNDKRAMKIIKEPLSNTKNIDHIFHEVQIASQLHHENILDIYDAGLIGDIAYFVLEYVSGGDLEDYRTSYLKANRPIPIHISLDIIKQILMGLGTLHSSNPIIIHRDLKTKNILMNYGDERLIVKISDFGFARELSSNADDFEVGGTKPYMAPECFNGVFSTRSDVYAVGVIFYLLLAGEFPYRLSDYVIGDIVDGKPWKIDLKPPSHFNQNVPKFVDKLVLKALDVNPNKRHIDAKDFENDLDKAIEKFKEYSYYKEYLNELKGLEELDELDNLGKLGELGEFGELKELEESSRIAELKESSKLGESNKDSKDQDHILNDNILEAFRLAKTEDGLDEASSILEKEVLKDYEIRKTYGKTLRLWKGDYPDAKLISEAFTVTLKGENYKLAIDLLREAFAYNPILKDTYGYYIDLWSIFIDLNKNKDFIISINRLENLMDRNDKIRDIYKDSIDTLKSYDEDRILNEAIDLADRGNLIDASKLLELLVVYDDEIRKDYAYKLSLWKQDLSM

SEQ ID NO: 6883 - protein, 381 aa, Methanobrevibacter ruminantium
MKKKLEYIQTEKIKNKNYEFYRNIENNKTVIFRKTKFGKREKVNIIDSDDLTEQIINLSYNKSSRNKKIQFPYDKICKFVFKNNFQACNIVFKLGIDFNYFLDTEVINQIFESTRSDIVICAKEEIIYIIEFQKDKLKKKDKIRFGNYQTNLHNYYHGRKVIVFVISFDPNEELGDIPYGYDKEYGFTMHVKSFNELDAEETINIINKRIRTRAKINFIDIVLLHFLPFMKSHRSQEELLRIAVDLTNQIRTLNEDKILELKITQTVLAQEILSEEEFEELFKVIKMEDTGLVEEVRQLYWEHKIRNDMNELNQMRNELNERSNQLNERSNQLNERSNELKEEGKIEVAINLLKLKQPFDLIAKATELSESTIRSLQKTIL

SEQ ID NO: 6884 - protein, 267 aa, Methanobrevibacter ruminantium
MSEEEIDYTEFIDFEDSNLISFKLAAINNKVRFSILEILRDFQKLNMNKDKTFKKDPYYSRELNEILLKKYDINISLQMLGQHMKQLLTAGLIEEVPLKKEVPNKIGARNVKGYILKPDAFEELFLEINFLSDELLSFFDLYKINQKFHDEDYCILTIFNGADKGKTFKVHKDDTVLIGRKADFSKGDLASFAILLDNSYTAVSNVGKPHLKLFYKDDSWCILDEGSTNGTFIGQNEVATGRITPLKKNSFLKLSRGEGGAVIYCSF

SEQ ID NO: 6885 - protein, 256 aa, Methanobrevibacter ruminantium
MNIRPSYSYASILNVFIEEKYKDNLGCFRNTNFYDVLDFQSDDSSFYYDMAFFSFYYGDYKSSFFLSQKAMILGHDEGDLKLLRLAAFNELSPIKKLLFDSIKEEFSNIIKEDDEELFLFYLEDMHYLEIALNQKDINVEEDFLNLISNLYIQVKYMDYVDYYAMINLYQFFYINKFYSEALLLINEILARNLNVFNLNRKLDVLFNINDIPGAYDVYQDIRLLDPNYFDSSPNREEMYLEVFTEHFFKNSLGKLE

SEQ ID NO: 6886 - protein, 238 aa, Methanobrevibacter ruminantium
MTNLELNILDLSLNELLRTVNKTESILKDQYDEIKEFRDIILTARNLRFDNGNDATIFLAGSGRSGFVAKFFAMRLMHLGFHVYVFGETLVPPVHDGDIILFISKSGGENAVTDSIESTKLENIKKSKSSPSKNNMIFENVKILSVCGSFDCYLASHSDAKIVIEAERDRKSTKEESERFDSLGFNSNELVIMGTGFEDSALLILDALVVEMMNNLGLCEEDLENNHENINRPKVSKK

SEQ ID NO: 6887 - protein, 370 aa, Methanobrevibacter ruminantium
MFELSGKYNTAKVFADNIDNDSVSQIIQFLNQPIAKDQSIRMMPDVHAGSNCVIGTTMTITDKAVPNLVGSDIGCGMETVYLDTDEIDFNRFDEIVRKYVPHGYDIRENPHPYIKKLRLTEMRCYFDLEAGSQGNFSLGTLGGGNHFIEVGKDKEENLVLVVHTGSRRIGADVCEYYQNQALKSFKRMHKTATNKELIYCEGQLFEDYIHDMKIMQEFASWNRKAIIETILSHYGMDYTDSFTTIHNYIDTDHNQMILRKGAVSAYKGEKLLIPINMREGSLICKGKGNKDWNCSAPHGAGRLMSRREAKDKISLKEYENAMKGIFTNSVNRGTIDESPMAYKPIEAIVNNIQDTVEIIDIIKPVYNFKA

SEQ ID NO: 6888 - protein, 586 aa, Methanobrevibacter ruminantium
MMGDYMNTDYLKEFEELNHTTESLFDLGISGLLIILKDGTNLTSWSELSNPDDILYLSADFRCKENYTEFSNFKNAKVLILQNYVRPNFGVGSLFFKEADLITKLSTWHSLVAFYGINWDISSTDSLKNMFANCLSLEYAYFEDWDTSHIRNFWGMFVACCSLKAIDGMENWDLSSAENMESMFESCMSLEDISFLSDWDMSNVENIFEMFRDCYSLKDASCLNWKFKNLKNGDNLFANCRKLESFPSWYDDEFINQFGIRNQLNLIDDDSFFYKIAGGFDPQDIFIAVGYIRDEECLKRLLRDSSVHFYARRAALLNPNLNDTEILEEFADSKDYVERAYAIENPNFTNIGIIRRLANNDKSHLVRFKAENKLKELKSEGLEIIEDYPREFKQAFEGHDRERASLVLSQWRGYDSTDANFILAKVISDSSDEEIEFSETFEAYIISMEEKPQDPSLFNWFSSTAVECMEKRVDEDIGFSQLFNNMYKSHMNSTDYATAFLDFFQDILENDRVEKLNLLRGLVDSWDTDCPDDANMHCAYVILNIKKISKDELEDRIAKAKVCIPENLNSYPKLMAFMNAVLEADK

SEQ ID NO: 6889 - protein, 314 aa, Methanobrevibacter ruminantium
MELEERIEEALEYIQNDSNYALELFNGILKEDPHNINALNGKGSALMKLHRNQEALDAFNDSLSVEENPSAYLNKGIILKINGDYRNALKSFDRALNYNPRLASIVSLLKNEILEIFEKESTDISLLYDFNESCTALIKKAYGYKNQGLLWDALDCLEEAVKQDPKSENSINDIIKKLILTIKKEFLYKEINSKSTKIDKLKFQTIKSIIVEDNPHKTLLLTNKIFEINENDLDALNYQGIAYFSLGEYIKSIESFDKCLSINPNYTYCSFNKGLVLRRMGLLNESLDCFNKVMNESDFLNKVKPFQEEVLTKI

SEQ ID NO: 6890 - protein, 200 aa, Methanobrevibacter ruminantium
MKTIAKPFQNSIDIKKSQFICRLFPAQTEKEAKDIIKEISEEYKDATHNCTAYVVSDGEGYDDNGEPGGTAGRPMLNVLKKNEINNVVAIVTRYFGGIKLGAGGLVRAYSKSVLECLAIAEIVEMELYELFRFTFEYQDIKAIDAEVRAKNLAVIEKQYEAQVIYFVATDNVGIVKSVQDKLAKQVKIEHLGSRYLEKIV

SEQ ID NO: 6891 - protein, 1170 aa, Methanobrevibacter ruminantium
MIVLNKRKKSWEIYPIGSPKGALNTKRQAEFVGILRFMEGEDGLSIKRFLIKSDKEEKPLAPSKAINLLRSQAVFLAQKDDEMEAFLEKNNVKVRFTNICQHCSYEGYVTIINSDFSYNYHDQLICKSCAEETIKRELQLRGYDKKVFRNFKKVLEKTGSLDDVLEMLSPRFDPLAHTDLTLFDTIKVHEDKIPKIAMKRLKVPKEFRDVLLKDNQYLLPVQYLAIREGLLKDENLLVVSATGSGKTLVGELAGVPKALNGKKFLFLTPLVALANQKYRDFKKRYEPLGLKVAIKVGMNRIKAKGELKLPDSNIADADIVVGTYEGIDFLLRSGKSDLLNDLGLVLIDEIHTISDEERGLRLNGLIKRIEHLFPNTQVIGLSATIKNPKTLAQDFNMKLVQYKERPVPLERHIVFVNGDVQRRLLMRKLVQREFYSTSSKGFSGQTLIFTNSRRKTHKIANFLSGKGINASAYHAGLSYFKKEKIEKDFSKGKIAAVVTTAALAAGVDFPASQVIFESLLMGNKWISPNEFSQMLGRAGRPSYHDRGIIYLVPEIGSEFDGESEESVALDLLESDVENIIVDYTEDGSLEQILADISSRSLTKVRDVINFYKDIPVPIDINTALEELRDKKAIEIHADDTIDVTRFGKAVAMSFLSIDDGVIIKDSINDKNYLSQYYSKPFFKTNLRELRRLSDRIDEENEEILNRNRKIQHKLDQLKKNESQKKEDKDKEDKTDKKNKKSKKNKSKKSKDSKKDKGKDNSKKSKKSEDSKKDKKNKNNSNKSKKDKSENKNKSNKSNKSKKDKSENKNKSNKSNKSKKDKSENKNKSNKSNKKNSSNKEFKDSKKDKKSKNSKDNKSESSKKDKKSNKSNKYNKYNKSNKYNKSKKSNKNNKNSSSKNKNDNSKDSNKDKTNHKESKSESNQSKNLEKDSHPISKDYKNSNASVSDDLKDYSKKVMYNKRINMSKKQHKTIEDKPILVNKLNFKENIFSEINPRMSKKEVNANNLLKVQSIALDLELFENAYLAPVVHKQIVSALKVNFSTRLFSESTLDIISSGEAIAKLDIKFQDALLKLQIDFLRCDCNDRPFCECLQRGISYYILNQRLNKRDPIDISKSLLKEYQIQAYPGDIFSWLDAYVRNLDAIKRVAQAYGKKDIVKEADKLIKIIETGK

SEQ ID NO: 6892 - protein, 128 aa, Methanobrevibacter ruminantium
MEEIVFKPIGYIKSKYETVENMPKSPREGMEDEAELIVNEEYLESMSDMKAGKEYMVIFYFHKSNGFKQRVPFRGDGPITGLFSTHAPNRPNPIGVSIIKVKEINGNVIKFNGVDMLNGTPVLDIKDA

SEQ ID NO: 6893 - protein, 112 aa, Methanobrevibacter ruminantium
MKRVVAVFRQQKFEDVKRALLAIGCEGMTISEVKGRGRQLGVKESYRGSNYCIDLIPKTRLELIVNEDDLEDVIDTIIESARTGEIGDGKIFVSDVEEVIRIRTGERGSKAV

SEQ ID NO: 6894 - protein, 189 aa, Methanobrevibacter ruminantium
MEENKKFAQKVKDIRERQQMSIEELAEKSGVKLEVLQAMENGEIIPSLTPLTKMAKALGVRLGTFLDDTEQLGPVVVRDGKMENTLYFSGREDVANATNLEFHSLGAGKHDRHMDPFMIDIDHDDEYELSSHEGEEFIYVMEGEIEVVYGQDSITLSKGDSIYYDSVVPHHLHAKAEKAKILAVLYTPF

SEQ ID NO: 6895 - protein, 554 aa, Methanobrevibacter ruminantium
MSELFTELPIGKFFEMQVEKQPDHEFMVYPDRNLRFTYEQFNERVDNLAKGMLSIGIEPGDRVGIWAKNVPEWLTFMFATAKIGAAIVTINTAYQSHELEYVLKQSEMKAIAMTDGFRDTSYFDIIYGLVPEIKERERGNLKSEEFPYLEYIIHVGQEKHRGMYNTNELLLLGMNYDNDKYQEIKDAVTQYDVINMQYTSGTEGFPKGVMLTSRNILNDGYYIGENMNYTEKDRLLLQVPLFHCFGTVLGVMAVITHGSTMVVLEEYDPLLAISPIQKEKCTSVYGVPTMFIGMMNHPMFDMFDMSSLRTGIMAGSTCPVETMKDAINKMNMKEITSVYGLTEAGPGFTQTNAADSFEKKISTVGRKFPNIEVKIVDPETGEELGPGETGEIMCRGFNVMKGYYNMPEKTAETIEPDGWLHSGDLATVDEDGYYSIVGRIKDMIIRGGENIYPREIEEYLFTHECVQDVQVAGIPDEKYGEIVGAFIIKEPGYDDITEADIRDFCIGSIARYKVPKYVFFVDEFPLTTSGKIQKYKLGDIGLKLLEERRERGEL

SEQ ID NO: 6896 - protein, 292 aa, Methanobrevibacter ruminantium
MTLVLIGPACEDLIIIGNEKSSRIGGASYFQSFVYEEFYDDYIAIVNAQNTDLINEFPDMSKTELILKDDTHYFINEYPDKDNRDIRKQSTNFADIPILADDLKAIFNNLGLNEDNIDAFVINPLNSNDIPLETLEYLNSFNLPIFISLQGFLRFKDKDNSMVLKSYEDLDYIFNIAEAIFLDEKELKIVSDEDKSDSKIEIQDIGFDEKTNTIFIITNGSKGSRITDFKGINIKIDSVKCDNIVDATGCGDSYMAAFISNLLNGNDLKDSGDFASLIASKKLEFFGPYRTD

SEQ ID NO: 6897 - protein, 938 aa, Methanobrevibacter ruminantium
MSENRCYDPDCDAEDCRNPQHYNYICFDPDCNDEKCLNEEHYNKQLLRDYQESTDLSVYDHREEIDYDEDVDISLCGCPDCADDHDHNHDHDHDHHHHHDHDHNHEHSHEHEHSYSHEHEHEHSHEHGHEHGDEHSHEHSHDHDHGHDHEHEHGDEHSHEHSHDHEHESEDTCGCGCDDDDCHDDLEEHSHEHDHSHDHHEHDHEHHHEHEHDHHSHEHEDEHHHNEEHSHEHEHSHEHDHDHEHHHEHSHDHDHSHDHHGHDHSHHDHDHGDSCGCGEDHDDDDFSLCACPDCADDDDDDHGQEELLAEGKPLIYNRPIQIMVSSGILFITGHILEFLSFSPTIVTIIYMLGALIAGYEIAILAYKSLVKRHTVGPALLVVIACIASFIIGHGEEGAAVALLYYIAEFLEDLAEHRAKRSIKSLVEIAPETARVKVGDGEESRRIEEVKVGEIVLVKPGDKVPLDGEVVYGTSSINQASITGESLPVTKTVGDEVFSGTVNEDGYLEVVVTKEAKDSVINKIVTLVKRSQLNRSTTETMVEKISKYYTPLMIIIAACVAFVPPLVFGQDLIDWIYKALSIMVISCPCAFLISTPIGMVSAITSATKKGVLIKGSTYVEEMRNVKAVIFDKTGTLTEGKLELNDINIINDEYSEEEIVRIAASLENSSSHPIAQAIVNYANEKEIGFEEIEDFRNVPGKGIIGNIGGKQYYAANESLIEGSQFNISQEEINQYSAEGKTLIFIGDEQSVIASITVMDRIRDNASEVIKDLKSQGVKTFMLTGDNKIAAGKVADEIGLDYVYSNLLPEDKLNILDTLRNKFGDVAMVGDGINDAPALARANIGIAMGAAGSDVAIETADVALMQDDISKLPYLFSLSQKTMNIIKQNITLAIVVKALFVILAILGLITLMMSVGIGDLGLTLVVILNSFRIAMVKDPLF

SEQ ID NO: 6898 - protein, 127 aa, Methanobrevibacter ruminantium
MKDYKEPTNDNHNDDLCEVFHPHEESIERAKKHVLSEEEYSDLAEFFKIFGNPTRLKIISLLSFEDLCVCDICESLGLNQNAVSNQLRILRAHNIVKFEKEGKSARYSLTDLHVEMIYKMGLEHMTE

SEQ ID NO: 6899 - protein, 212 aa, Methanobrevibacter ruminantium
MGKVFIMSYIFIDESGDLGTKKSSSKYFVMAGIKVEDSQKLDRVIRKIKRDDKKNIITSNEIKGSNLPHDIKIKILKKLDSVNYQVFIIIFEKINRYKVNDGYDNIKLYDLLACELAKQIDISSSSKIFIDKSKNKKEEIVNFNKAFLENLNNFKKFPIKLEHANSMSYKGLQIADLISWAIFQSVEHNNNEFIDLIKNKKIKRVFEEKKNL

SEQ ID NO: 6900 - protein, 60 aa, Methanobrevibacter ruminantium
MNSEFIILFSHILPLILGFFSILLMINGIMDKQKVITAFGIILFLAAAFSPFVVLPILGV

SEQ ID NO: 6901 - protein, 231 aa, Methanobrevibacter ruminantium
MLEIIPVIDLMNSVAVSGKSGNRETYTPLQTIYASSSDPLEIALSLKSAGAKEMYIADLDFIERNGNNNIFKIKEVNSVLPVILDVGVDKLETFEFLLEFAYKIIVATETLESIEELGKIFEKYPKERIIVSVDVKNNELYAKNMDLDLEGFKEVLRRIDPNEIILLDISSVGTEGGFNKPLLESFEEFKDKIILGGGITPDEISQLDALGIRKALVGTALHKGQIRLNPF

SEQ ID NO: 6902 - protein, 207 aa, Methanobrevibacter ruminantium
MEKSEIEHYLRDIWVREYERGEKLVVDEFNADDIELLAKKEYIKTDDGFVNLTENGEYLGRSLVRKHRIAEKVVADLFLADMDEMEELADQIEHVMSAEVEENICRILGNPENCPHNNPIPKGDTTPGISKEYSVPLVSCHSGESGEVSHIKTEDARKLRKIMNLGLIPGSRICLIQKFPNYVFQLGNTQLAVDKELANEIFIKLDE

SEQ ID NO: 6903 - protein, 72 aa, Methanobrevibacter ruminantium
MDENDNKSQIIKCEFCGFTFQKCDGISCDSCPINCKTVRCPNCGYEILPESKSYKFLEDGVKKIRNRLFKSI

SEQ ID NO: 6904 - protein, 398 aa, Methanobrevibacter ruminantium
MIETDVLVIGAGPAGSAAAKHAALGGADVILIDKKSEIGTPKRCAEGIYDHGLKWLGIEPDPAWAVQRINGGTLIAPDKTRLTLDETILPEKGYIIERKVFDKYMAMDAARAGAQIMVKTQAKSIQRGEDSKGSFYTVDCEQMGEIIEVKARIVIAADGPESRVAKAFGVNSTTKPKYMMSGVQYEMVGVNCERMDLIELHLGAFAGGGYAWVFPKGDDIANVGIGISSESDRPAIDYLNEFIESYPPLKDAKPVELNVGGDPIGGLIGQIYSDNLLVCGDAAGQVDPITGGGIILGMLGGMTAGQVASRAIKDGDYSKERLKEYDELYDEYTQGAIPKLAVGRDVYLSLSDDDLNQIIHAFEGLDYKSMSPKDILKVFFKLSPRLALKFRKLFKVVL

SEQ ID NO: 6905 - protein, 302 aa, Methanobrevibacter ruminantium
MFNKKMVLAISLLAVIFASMCIVSADDSGEGSFKELAKLVSGDNKTGVITLTKNFANTDGYDADGIKITGDNLVIRGEEGKDITIDAKSAGRIFNANGTKNVTFENIHFVNGNSSDAGGAVLLGEEPSSSVKNCQFDNCYSDAFGGAVDGNAIGCTFEDCSANYHGGAIFDGSATNCTFNDCFSKSCGGSKFPIIRQPIANFTDCYSYWQGGALYEVEAIGCDFKNCYSSEGGSMCGGSAFNCNFQDSLAKNGNGGATLNTTAKGCSFSGCSVTNGEGNAMYGGTATDCKLDKADAVKVNFK

SEQ ID NO: 6906 - protein, 146 aa, Methanobrevibacter ruminantium
MANLSFINNNFKMIVGILSIILAIVVYFITPPYIEFYLIFVFLIPAIALIVPNDAIKNSRAIGALTFILVIIVAYFAISGMLGAYDVLTNMYVNGLINSTPSTSDISACSNGYLMVLIYALFNIFCGALFFKRTSSIDDVDDEDAF

SEQ ID NO: 6907 - protein, 468 aa, Methanobrevibacter ruminantium
MQLDFNHVLTRISDYEKPIVLNHDVVLTRSEAHQFKKGIEIKRDNIVIDGNGHSIDARGKNRIFNVLSKNVVIKNFTFKNGFSEKFGGAIRVAGECKLINCTFENNRAKKGGNDISNGSELSICHCNFSDADGSINNLGTIYLLKDEEHEIKPLISNNGEIKRIIPKHDVSFLINGDKDHIKGALIRIGDKSGFSNDEGACVLEGIEEGKHSLEVSAEHYISFNGNIDVSENNVLFDIQLERLIQRHDIKILVKHKGEPVSDAIVSVGGIKGSTDENGECIFDDVEEGEISVKVNSNEYENQKYTITVSDNKTTFPINLGFTHLITPFPASDEDPYIFASYSHDDANRVFLELKRFHDCGLNIWYDEGIESGLGWQGVVESKLKACTLFIAFISANAVESINVRREIFLAINKKIPVVPIYLEKTELQYGLDLQLSPVQAILKYAMTEEFYVERCRRAFVMYGLMDEE

SEQ ID NO: 6908 - protein, 252 aa, Methanobrevibacter ruminantium
MAKVTSIFFSPSETTKKVVNQIAENFKEEKSICDLLYFNDKKEFESDDIVIVGMPVFAGRLPKTASERLSKLTGNNTKAIAVANYGNAHVNDALIELVDILNENNFDVIAAASTVSHHSIFDGVALGRPDEDDIEKINDFAQKAIEKIENGGSLESDIPGNRPYTDYKQLPFVVACDVDKCVFCLECVSVCPEKAIPDDDPADIDLEICSRCTACINICPEDARSFAGDAFLSKKPLFEEANAERKEPEFYF

SEQ ID NO: 6909 - protein, 98 aa, Methanobrevibacter ruminantium
MEAKLKKLTQEDIDDISDFFAGVIDKKIASSVKSQKEILAMDIDIEVAYNDENEELMVDVDVDITTDELSNLSDEKVNQLIEDSYVELDEYINDNYRK

SEQ ID NO: 6910 - protein, 115 aa, Methanobrevibacter ruminantium
MEIPQNVQHQLNQFQQLQQQAQAVTVQKQNVDIQLRETETALDELKKTPEDAEVYKSAGNLLIKVERASTLEDLEDKVETLKLRQQTMQRQEERVMKKLEEMQASIQQAMQGLQG

SEQ ID NO: 6911 - protein, 44 aa, Methanobrevibacter ruminantium
MELTLDGNSIKIKIDAEDATSFRASINSAIKWIKLAVEINELVE

SEQ ID NO: 6912 - protein, 163 aa, Methanobrevibacter ruminantium
MLISTSRKPSQKTRTFCKNFSHAFGFDYTNRGKSSLRDLLVKAKQLGHDGLVLVYQIKGNPSKLTFYDLEENERLALLISVNTTNERLHIKPEELKIRSTVPELDILAEVLGIEVTKEPQDSNYIRISYADYDDESNFAILYFINKKGEQIDFRINVKKIVEP

SEQ ID NO: 6913 - protein, 43 aa, Methanobrevibacter ruminantium
MYKCPECGEEVDHKGYMENKCPKCRYRILFKKVPEVRKLVKAR

SEQ ID NO: 6914 - protein, 89 aa, Methanobrevibacter ruminantium
MARTKKVGITGRFGARYGRKAKRSVKNIEENMKKKHVCPKCDRPYVKRVSAGIWECKKCGVVFTGGAYVPETPMAKSATRSIKRVVGGE

SEQ ID NO: 6915 - protein, 263 aa, Methanobrevibacter ruminantium
MDIVPEITRKSITRLINDGKRADGRAFDERRDIFIEPNVIDKAEGSARVKLGDTQVIVGVKPTIGEPFADTPNLGVLMTNCELLPMAAPGFEPGPPSPESIELARVVDRGIRESELVDLEKLCIEEGKKVWMLFIDLHVIDYDGNLFDCANLAVMSALLNTKLPVAEYIDDEVVLSEDETMDLPVRDKLALSTFVKIGNGLILDPSLEEEEILDARITIGVTDEGNHICSMQKGGEEPLTRDDILDAVHLAFETKDDLLSYLD

SEQ ID NO: 6916 - protein, 236 aa, Methanobrevibacter ruminantium
MFFIISENEKLRGDGRAYDELRPIKIEAGVLKRADGSAYLEVGGNKILASVYGPRESYIRRLLKPNTGVIRVRYNMAPFSVDDRKRPGPDRRSTEISKIAADALRPALMLESFPRSMVDVSIEVIEAEGGTRCAGITAAAVALADAGIPMKDIVVGCAAGKVNDEIVLDLSEKEDKEGQADVPIAIMPRTGEITLLQADGNLTEEEFEEALDLAIEGCMKISEIQHEALKTRYSSQ

SEQ ID NO: 6917 - protein, 491 aa, Methanobrevibacter ruminantium
MGSICMIYVNEKDLVVPGELLAEDDYYSGRGTFEDDGKICSKLLGLVSLRNKKISVIPLKSKYIPKKGDVVIGKIDDVRFSMWGVDINSPYSGILPASEVFGREKKELSRVFDIGDVLFLRIVDVDEVKKVKLGLKGRGMGKFRGGVIVDIAPTKVPRLIGKKGSMINMIKDKTGCKIVVGQNGLVWVKGNEDMEQIVKNTIKLIEREAHTSGLTDRVKNKLCLLIDGELPEEETEVMEEKEEIVEESFEEGLKKPEIQDFRDEVEKEIAEEMALEESEEDLDEEFDDSEELDDSDEEFDDSEDISDDEDFDDSEDDLDSEEEIDYADSEDDEDELAIEELEEKVETEEFMDDSDEDSDFIEEDIIELDEDAESLNEEDDEEEFDVLEESEAEIFDEAEVLDGAEEISDDELEEVINEAISEDEESQDDSIEDESEDEEEKEKEEKSKKPKFLDTFEYINEQKKKNKSSFDLSRADNSDSPTLNISQRRGI

SEQ ID NO: 6918 - protein, 234 aa, Methanobrevibacter ruminantium
MVNIDDAIIARLESYGEKFEILVDPDLAADFRNPDNEKEIDIEEILAVEEIFKDSKKGDKASEESMRKVFDTTDVLEVAEQILHKGNVQLTAEQRRQMQEDKRKQVVAKIAREGINPQTGLPHPAVRIENAMNESKVKIDAFKSVDEQVQTTLKAIKVLIPIKFEKIKMAVRLPSTAAGNGYSAIRPFGTILNEEWQQDGSWIAIVEMPGGLQDDFNHKMASISGGEAETKVIK

SEQ ID NO: 6919 - protein, 47 aa, Methanobrevibacter ruminantium
MSVKKLIIKKVILSKTARKTAKKGIMFVVPSDFFDRHRHLGKIVDMM

SEQ ID NO: 6920 - protein, 294 aa, Methanobrevibacter ruminantium
MQPLQQQNAGYDRAITVFSPDGRLFQVEYAREAVKRGTTSLGLKSKDGVVLIVDKRTVSRLVEAKSIEKIFQIDDHIGVATSGLVADARALVERARIESQINKITYNEPILVGGLAKKICDLKQLYTQNGGVRPFGSALIIGGVNGEETRLYETDPSGALIEYKATAIGSGVQAAVDVFEERYEEDLSLEDAINLGLDALYEATEGRTTEDSVEIAVIEVATQAYRKLSDEEVSGYVKDLLERNAEEEEPEEEAEEEAVEEAVEESEEAEDAAEESEEETSEEEASEDKDSAEE

SEQ ID NO: 6921 - protein, 747 aa, Methanobrevibacter ruminantium
MNFMKTNLKKTTIILALLMAILILSIGAISANDLTSADSNVDMNNDLNTNLDSNDIIANSNSNSIDAEIDEANYSNQRADAKEKLKESNSLIENENTEGNTQIEDENSSPSNKTDTSISIETNSIERGSDLTIYLKDINGTGIANEKLSIQIINKTYTRTTDSKGSALFKINLASGKYPIAISYNGSEDYESSSDDFNISVSPMKTKINMLSNSIVNGRKLTIELLDKNNNPLKYKKISIILNKKLYNLTTGKDGKVSLNINLNPGKFPIQITFSGDANYHTVSKSSAIDVYKLKSSFTVPKTSIIKGKYLYVYLKDSEGKAIPSAKVAFKINGVSSTKTTDKNGRISQKIGLKVGNYTVQLNYNGDKSHLKKVQSFKIRSCNSKTKFTVANYTVVRGKYLSVYLKDSENANLANKKVTFTYLKKSYTKTTDSNGKASLKMTEAGTTTVNLQFKGTGPYLKSSANVKIKVLKNTTADIIAKNQTRHLNGSSTIRYYVKLTDNNGNPIENETIELKVRCNNITTGSGNKITKKTIVLSSDNIINKSEDKKLLNEMAKILRAKGYKVIVSGIGPNYHVSDVRDYSNVCVFSLVGGVDSGMFVDMSHSYYKNYLKKYKNQFVLGCVAPPVYLNLGNMTWLKRAHDDDYSPKSFKGLYYPGKYFNTVTKLDYVYGDGAEELVNNFLNYAKKGKSIDLGQSVPKTTTTYKLTTDKNGNAYVDLQVGTYTISSSILGNNYKVDTQTSKVNVIK

SEQ ID NO: 6922 - protein, 125 aa, Methanobrevibacter ruminantium
MKLKVLPPTLRKNHHYLILDVKSEVKLSKDDIVHYIWDACIRYWGENHSSNFNLWVMRHYPIEETIYNNEPVFNYKTVLRCQRSYEDDVRSALATLNRYNKKKISINTIGISGTVKSGINKFIDE

SEQ ID NO: 6923 - protein, 323 aa, Methanobrevibacter ruminantium
MKFHDLNIRGTDYNNDLALIKEAYKFGWDYLNLNYSQDHYKEALSYKDDLLEEISLFEWKDSYRNKYNSQSIEISMGINIQNANSNEIRKIVNKYRNNCSYMSALGGDLKVNRSVCENHRMDVLSRPYYKRRDSGMNHVLAKEAARNNVAIELCFRDVLKNSLKFRANIISSFKEIMMFHRKYNFPIILTTDSKSIYDIRSTKDIVGFFKSIGFSDKEIYNGFYYYPREIIDFNRQRKNMVIKGVKVIEGASDFTEIDSKTPKFEESECFDEAISQKEDDFFDCDESEDDFSDYDEEDEVFVGESEDEFTDVEFESLEKEDLL

SEQ ID NO: 6924 - protein, 146 aa, Methanobrevibacter ruminantium
MIHNIRYRVFIYENEDKDKVLEALLNILPTAEPEAEEAEGLLEEKMLILTGAISKKRETKEFLNTLIESIGEDQLIKLYNDLDRKMDEKGNLFLRLSKEKALDEEWEILDGGDSIHLKIKIAAYPAKKEVALKKIKEVFPEDIINA

SEQ ID NO: 6925 - protein, 183 aa, Methanobrevibacter ruminantium
MMYKYIRDAWKNPDESYVRELMWQRVPKWRKQPAITRIDRPTRIDRARSLGYRAKKGFVVVRVKVRRGGRRKTRFKHGRRPKRMGVNKITMAKSIQRIGEERVAKKYPNMEVLNSYWVWSDGKYKYFEVILVDPQSPSIKNDPKINWICEKQHRSRALRGLTSAGKKGRGRRNGGKGSEKRLK

SEQ ID NO: 6926 - protein, 139 aa, Methanobrevibacter ruminantium
MIKCDNCGLKFDDDTEICPNCGNKLDSTQSVQETEEASKKCPSCGSLIGINEFICPSCGNKIEELKIIRTCPNCGVNLDDDAVFCDNCGANLSSTSDQIQEFNKSLIESNKSLMDQIADLLTKFGKFIDDLFSSFKKDK

SEQ ID NO: 6927 - protein, 306 aa, Methanobrevibacter ruminantium
MVKCSNCGAEVGDASFCFSCGEKVDGGNVDSNICPKCGTENSKGTVFCVGCGQKFDNALVPESVARKQKEWELRRQQIIERYDQLADEFGIKDKDYFLTSVVRVNMLEEKTTKHKVWGSVGSYGGNKTTIDGFFLIEDDKFVFMEIDNRDWKKVNAGINNFYFDKIVSMRITKRLGDISRYEDITKRTSLNSAHAIKRAIQNDIQSLKATRFKDLIVNNDSADMFDRLLIKLVDNTSFEIRLPSFEFGENLVALFEISRNSPQTVVIETDSKPSKADLLKEYKELLDSGAITEEEYDELKKEVLSS

SEQ ID NO: 6928 - protein, 177 aa, Methanobrevibacter ruminantium
MLVRNLDFLSIPKEFSKVELDIYEGKSIVLVYIENKGYSLVLKKNNENDSIFLLKTDLAPDNIDSDKEDFINVIKMLLDKIYEGAEIKEYEKQHHEHVFLQLMDLLIEGETVETITEESKIYADIEKGFMKLELDIMDNKINSLNSAIGEISGNLNNLGSKVEDSKIENRLKKTFSQ

SEQ ID NO: 6929 - protein, 182 aa, Methanobrevibacter ruminantium
MKDPNMDRILEDNRKLMEENRKLKEDLKELKNEFYQFKKNSRPGKPFNLENNDDYKPSGNYYFHNNFKEEFDDANIKYNSKDNPEGSFHNDSANIVDMSLISFLARSNKRVEILKSLNQGDKIPSTISKEIDDSSHHVSKYLSSLKEKELVVCMNEEDKRFRFYRITAKGKYYLEIIQNNQY

SEQ ID NO: 6930 - protein, 181 aa, Methanobrevibacter ruminantium
MADLKGTKTEENLKAALAGESQARVKYEFYASQAKKDGYVEIKDIFQESSDNEKEHAKIWFKLLNGGKVPDTLTNLADAAAGEHEEWTSMYKEFAETAREEGFDDIAALFDAAGATEKAHEDRYNALTDKIKADKVFKKDEEIAWKCNNCGYIHYGKDAPEVCPLCDHPQAHFRKQDTSYI

SEQ ID NO: 6931 - protein, 325 aa, Methanobrevibacter ruminantium
MCTASEYLTENHYFGRNFDYEISYKERVCITPRNYEFKYRKIDDMKSHYAIIGIAAGIDEYPLYYDACNEKGVAIAGLNFAGNAIYREMEEDMVNVTPFEFIPYLLSQADSVEDVKELLQNLNLVNINYSENLPLSPLHWMISDKDSSIIVEPLEDGLKVYDNPVGVLTNNPKFDMQLFNLNDYRNLSVKTPENTFSKNLNLDDYSRGMGAIGLPGDLSSASRFVKVAFTKENSFSGTSESESVSQFFHILGSVEQQKGLTFINDPDLYEYTIYSSCYNTNKGILYYKTYDNHQITAVDLNREDLDGDGLIIYPLINEAQINFIN

SEQ ID NO: 6932 - protein, 181 aa, Methanobrevibacter ruminantium
MKILALIGSPRKHSNCEAIVDEIAKGAEENGHEVIKYIIQDLDIAPCSGCELCRKGKDCRYTDDGTEIIDQLADGASVILASPIYFGQMSAQAKTIVDRFYSIFNNPNKSFSKDAKAAIVLTHAYPGDYDAYLQLTIAQPFQNNTEMEFIGAIDAGDLKFPGDVKDKPEILREAYELGKKF

SEQ ID NO: 6933 - protein, 498 aa, Methanobrevibacter ruminantium
MKELYEKMINESVAALQADIDVISANRYNDFKIVDAKPYADAVAGMTCIDGQAKSVIDLHKKSVESHYKVLTSVAETIRPEDDPFIEHYQTPPILEILCEEDGEFADSMATFIQAIADSETLITRESVRRYGGFYGPTCVVDFALMPGSTSNVVNQILKTIHIPVMHKQAILSAKSWGMNTSYGIGDSFAHAIENGATAAEAAAKEVESMQMIYKEPVEAQGKLMDDAGHSSFDVRAFMEGYKKEMRPVVKAAMDDGVHYGNIVTVPAYCVGDIGHHIGQASYNMCKDDVTLAIIQATAKVMEASLKDNIGKFMHPSQVLNLATGSTACATEYILELDGFNSTMVVDLLTKRFHNFVQQYPTRGAAAELHNCDFMDMIHRGSTYISAARKARSSAKIDLVPKVNGFAVDLGAITHNEVLMNPQRYTYPACGITVRFSSLMRLADYPCLLTPEPVTATMMTNIIALNKEVPGSPVRGCKNCASCIIDAKHEYCQWKESV

SEQ ID NO: 6934 - protein, 208 aa, Methanobrevibacter ruminantium
MNEIVLNHPLITHKLAILRDVNTGTKEFRELVTEISTLLCYEATKDAKLEEAEIETPLAKMKTGKLNEDNYAVVPILRAGMGMVEGIINVIPNAKVGHIGLYRNEETFEPVEYYYKMPDGIGDRIAMIIDPMLATGGSVSATIDKLKADGVKQIKFLCIVAAPEGIRALEANHPDVQIYCATVDEHLNPNAYIVPGLGDAGDRIYGTK

SEQ ID NO: 6935 - protein, 395 aa, Methanobrevibacter ruminantium
MNSTVGEPVLSVPVALITSGIGTLIYVICTRNRSPVYLGSSFAFIAPMVAGYAIGGKSSIFSALMVVGLVYVAIAIIIRATGKEWINKLLPPVIVGPMIMVIGLCLAPTAIQEIGLDQAVVPINNIIVALAAFLTTAVIAIRGKGVLKVIPFLIGIIVAYVVAALLGMVDFSGFFSASLFEVPEFYMPFINYSFNPTALLTIVPIALVTMVEHVGDHKVLGEIIGRDLIQDPGLNKTLLGDGLATFFAALLGGPANTTYGENTSVVGLTRVASIYVIGLTAVFAVIFAFSGHLTALLAAMPNPVIGGVAILLYGFIAVNGVKLLIQEEVDFNNNKNIVVAATMLVLGLGGATLSVAQGDLSVSISGMALAAIAGVILNLIIPERKEDNKFVPEVK

SEQ ID NO: 6936 - protein, 159 aa, Methanobrevibacter ruminantium
MAKLTFRNASEEDVPLILEFIKKLADYEHRLDEVIATEEALKYWIFDKQQAEVIFALEDGKEIGFAFFFLSFSTYIANVNMHLEDLFIDPEYRGNGYGKALLRELAKIVKERGYGRFEWTCLDWNQPSKDFYKSIGAKQKDWNVFHFTGQELEDFINED

SEQ ID NO: 6937 - protein, 484 aa, Methanobrevibacter ruminantium
MDYDVIYIGSGNASWQGARFLRKEGLKILIIEKSLYGGTCANRGCNSKALLDAPYEIKAFADNFEGYGKSGNFEVDWPALMKLKRKRIANMAPFLDGKYKEYDLDVAHGEGYIVDEHTVRVGDKTFTTDKIVICTGLKPIIPDIKGKEYLHDSTDFLDIEELPKHAIIIGGGFVGMEFASILAEAGLEADVIIRGNMALKFFHQPYVQNVIEILKEKNIRFHFNETVNEVIKDDSVVIENPEERVNIFENAQNTDDDLRDPDAKVDNKAYENAFTVNCDSGLSLTGDYVIAAMGRTANVDTIGLENVGLDYTKAGIKVNNYLQTAVPNIYACGDIADTGIAKLVTVAIHQSKYLGKALLGDAEEIVYPVVPAVAYTIPRIATVGVPAYIAEQSDEYDVHRIRYGKSYSLELKNDTRSEAKVIVDKDLNIVGAEIYAADAENVANMFTFIINQKITLEELDNMIYAFPSSSSVCLYKLHNIHYKF

SEQ ID NO: 6938 - protein, 179 aa, Methanobrevibacter ruminantium
MRICVYGAGSTQIKSKYTDEAYKLGEEIAKRGHDLVFGGGSTGIMGAVSKGAIDNHGKVLGIAPEWMEEFEGICKDCDEFIYTESMDERKKLFLENSDAFIIAPGGIGTLDEFYEVIVLKKLNRHDKKIVIFNMFNYYDHMLEMIDFMIEEGVIRAGRDKKTFKIADSIEKVFKILERE

SEQ ID NO: 6939 - protein, 163 aa, Methanobrevibacter ruminantium
MSHPHVESINNMNASSLIGIMEESKITYVRENLDIHLHASQIKLLKQVRKHEKPHHKRIRVKRYEQAEKSDLFNLHLDLYLNNYKKLAKKGLIEIDEDPENGLPYDCALTEKGKEVLDDIDRLEKDWEKVVHIDDNDLEALKRIALDSFEISYQHKKKQNFIF

SEQ ID NO: 6940 - protein, 106 aa, Methanobrevibacter ruminantium
MGEKVFYGKGIRRIKEEDPQLYDSIENLDKNIWNANSLDYRTQKLIAIAISATNPESSSFLKQLSKAKKELDISRDEVMDVLKVVLLTSGMMPFNKALEVVNKLYD

SEQ ID NO: 6941 - protein, 111 aa, Methanobrevibacter ruminantium
MRVSIMKEEVFYGKGMERVKKEDEGLYQAIVGLNEAVWNGKVLDYKTQKLIAIGIAASNADSRATERQIMSAKKELGVTRDEVVDVLKVVLLTSGMQPFNKALQIANKVFE

SEQ ID NO: 6942 - protein, 137 aa, Methanobrevibacter ruminantium
MKMPEKIDNMMFAPCGMNCKLCIKHISKSNPCPGCLIDSPNKTKNALKCKIKKCLETKRVKYCGRCSEFPCKLMKKQDKNYKKRYNYSTLDNAKRITYTGINRIMLEDKLNWECPSCGGIISIQERVCSDCGLNKED

SEQ ID NO: 6943 - protein, 257 aa, Methanobrevibacter ruminantium
MEIEHTHELIKDVFGMNMKEARLLDDLLKTNDLSEILELGFAHGVSSCYFASTLKDMGKGHLTTIDNTTAKTRNPNIEELLKKTGLEEYVTYYFEAVSYNWRLMKLIEENNGPIFDFCYIDGAHDWNNDGFAFLLVDKLLKPGGIIIFDDYNWSFSRSPSMSQSPRVLAMSKEEQETPQIKKVYDMLVKTHPNYHNFKILNDNSWALAQKKEEEDLFENQVNKLESENRKLRKKQKEIMSSNSWKMTKPLRQLRNKK

SEQ ID NO: 6944 - protein, 211 aa, Methanobrevibacter ruminantium
MKAKEMMDKKFVYVSKDDTIEAVSIKMEESKRFTAPVLDKDMKLEGWITSFNITKGLREGKKLISEVMDPVENILAIKEDEAAKNAVIEISKHKLISVPIIDDENKVIGVCRSVDVVDSMSSLYDIKVSKIYEAMEKELKGVTWDELMEASAKISTRTTGVKITAEEYEKNIQNATFGEAIWATGGLEKFFAGLISVGEIVIARKVGRARR

SEQ ID NO: 6945 - protein, 275 aa, Methanobrevibacter ruminantium
MEIKLKKQIETLEREITLKSVDLDEDIEDFNVDIHSYEDNDKLITISPRCVRCNLCVEECPINVISSSTWLKRAKIGEGCVQCEICAQTCPVSCIYVWDGETVIKEDDSVEYTLKELKVPHRNLKMEDISINREVCIGCGSCLKYCPTNAISLRSKEFIEAHGEECPEVGAIDSEHGHMYSYIDKDRCCGCGSCANLCIQGAITLKRDLGPVVIYSHLDVNQDICVACELCEDNCPVGAIKVVDGEIVLNNDKCIRCKECSSRCPVGALNLVSDN

SEQ ID NO: 6946 - protein, 342 aa, Methanobrevibacter ruminantium
MDEKDLKSSNNVTAEDLGVDEIVYDAINVDVIGFGALNVDKLYRVGHIAEIDEESFIKGEEQSPGGSAANTIIGLSKLGCSTSYIGKIADDEEGDLLEYNLMVNNVYLTNLIYADSGNSGKVLGFVSDEGDRALYVDPGVNDDITIDEINPLNVNACKILHYTSFVGDSFNAQKELLNVLGDDIVLSFDPGMLYVKKGVLELKEILERTNILLINENELKILFEDHYKEKLSVSKDLTFRDLAVFIRDDGIDTVVVKRGENGVYAINKDDDEVKAPAFKCEAVDTTAAGDSFNAGFLYSYLKGYDLAKSCLIANWVASRSVQAIGISGLPNLEELEEFISSL

SEQ ID NO: 6947 - protein, 368 aa, Methanobrevibacter ruminantium
MVKKVFITDCEGPLTLNDNAYELAAEFIEDGDKLFKIISRFDDYLVDEVHLENYHAGDTLKLIVPFYKLAGLTNEKMIEFSRNNIYIVDGSKDTLKLANELMDSYIVSTSYGQYIEALCNYMNFPFENTYHTQLDIDGATNFNQSDKKSSTIGVKSPLFIEELKKVEEFRKIILEHGDENEDDFNVLYDIFFNEFPKLEINKYIQSVKTVGGKGKQIAVEDIVERLSLEEGSIIYMGDSITDVEPLQYARDNGGLSVSFNGNEYPLNVAEIAVISDNTIVSSILIDLHSRFDKDYVIDFVKAYAEKGPDDAFKDFEVDYSLVEEFEKIFYNRQAPIIDIITDENRDYLLGLSKKMRNGIRGKDIGGLG

SEQ ID NO: 6948 - protein, 37 aa, Methanobrevibacter ruminantium
MIHKKYYMKNEFYLLIKEINQNMMFIYSKEYYPKTGR

SEQ ID NO: 6949 - protein, 483 aa, Methanobrevibacter ruminantium
MVTVNPIPRPLRDVHIEYEIDNEKCINCSDKPCLGVCPIDAVYQDENTKLIKLDEHCFGCVLCSNACPYDAIHIKKTLSEPIRENVPNINKKLCRACGACVNACKSGAIHLKSTGGEEMHSEIDENKCIRCGYCFRACPTDAIKYGEILPKTVKEGKTLCIDHDQCIGCMTCTRICPSKGAINVGKTNKLPFIDPAYCARCEECMHACPTYAIDYVEREEAFESFNKIKTLEIASEILDRDINKISKGITNIDNVLVKLLDDISKDYHFDDFDYENSMDIRDVPRGMEFSDVEIFTCTNCRSIVVNVTEYLNERLNAQLNKDLDVVKVLDLVEFFPPSLGIEVVEENCISCGLCMDVCPTKSISLDGPNPIKIDTDNSCVYCGLCAEACNFEAIKLAEEFFTNRNHEIFFIKRDLRGRRNGTVEINHSACQLCEVCIKNCPVDAMSVEDDMITVNHDECISCRNCEGICPVNAARVSTIWQFL

SEQ ID NO: 6950 - protein, 344 aa, Methanobrevibacter ruminantium
MSSIIWYIYEFARKTWIDGFFDAKSKEDIAHKPDRFRDFPNVIKENCIGCGSCTASCPSPNAIKLIRDSDTEDAFGLIYPVINKASCIRCGFCAEVCPSTPKTLECGENHFIREEFNIIPSKRKYIVDDYLCIRCHKCMDACEVGAIEEFDDRVSVNQSKCISCGKCLEACPVKGAMRGVFVNNLEEQKKIINLAVTTLEDYIESKQDDLIQLGTDKLFLDELPFKPIFDKSLNILNDKEVVHEVLEDAINRLKIRIITWDSENCKKCQMCIPDCPTGAISFDYDKDTIVRDKEKCLRCSICYQTCPFGVIKYFLAKFNLDKNDNDEEVIHISVKASQLAERRA

SEQ ID NO: 6951 - protein, 375 aa, Methanobrevibacter ruminantium
MILPIGPIHPGLKEPLRLKLQTQGEKVIKAEIDYGYVHRGIEKIMEGKTWQKCIYLSERICGICSYEHTQTFAETLEGISGVQAPLRAQYLRVITNEIDRIQSHLLANSTFFKTLDHETLFMHVLALREYAMDSLELLTGNRVNLGWNVVGGVRMDADERHFNAILENMKKIEDGFDRHVALFEEAPIVALRAKGVGVMTKEEAIKGHAVGPIGRASGIKHDLREEHYTYKDHFDFKPIWRKEGDNYARTLNRLYEVEQSIDLVRQAIENMPKGDIRTPVDIPSGYGEWRNEAPRGEVRYMAETNGDLIKRISIRTPSIMNIDSCARYMLKDVATVADAVSTYASSDPCIACTERVAITDIDSGKYTTKDFFEVK

SEQ ID NO: 6952 - protein, 153 aa, Methanobrevibacter ruminantium
MLKKLKDIVRKSSIHVCIVNCGGCNGCDVELVALLSPRYDLEQYGIYVHNNPREADVLLVTGAVTEQWRDNLRRIYAKAPEPKIVVAVGNCPQSGDVFAQEGGRVLAPVSDFIPVDAAIPGCPPRPSEILEAVLTVAPGAIAAKGRAQDARKD

SEQ ID NO: 6953 - protein, 127 aa, Methanobrevibacter ruminantium
MNSEEKYEMMKLRVLHSFKWEKDLTIPLSEEFGISKEEFEEILMNRFDMSDLENMHATFEIANREKIKRQMHLDLRLYWLSDVAKLISEEDADRICHQLTKDVIQHGKKYEDALDEGRAQIVELLRE

SEQ ID NO: 6954 - protein, 51 aa, Methanobrevibacter ruminantium
MNDEKGMRVLTFISCFRSLYCCRFSSILPKHSSISYGYNRFNIRSIYIDAK

SEQ ID NO: 6955 - protein, 108 aa, Methanobrevibacter ruminantium
MISIGANGFQLLINYIVAIVVAVIIAFALRLPLLPERPIRFSWTTSALFPTPIFAIGILAIFYSLNVYWIYDGLILSVIVGLASALFVKYGFDYIFPKPPQIEDGGNV

SEQ ID NO: 6956 - protein, 497 aa, Methanobrevibacter ruminantium
MKIEVLDTTLRDGEQTPGISLNTIKKLRIATKLDEIGVNSIEAGSAITSEGEREAIKAITSQGLNAEIVSFSRTLIKDVDYCLECDVDAVNIVVPTSDLHLQYKLKKTQDEMLEDAVKVTEYAKDHGVKVELAAEDSTRTDIQYLRKIFKATIDAGADRICPCDTLGILTPLKSFNFYKQFTDLGVPVSAHCHNDFGLAVANTLSAIDGGASRFHATINGLGERAGNAALEEVVVSLYTLYKDESNERKYETDIKIDQIYSTSKLVSRLSNAYLAPNKPIVGENAFAHESGIHADGVIKNSATYEPIMPELVGHRRKFVIGKHVGTKGLNNRLEELGLEVNKKQLNDIFYKVKDLGDKGKTVTDTDLEAIAEHVLNIEQEKKINLDELTIVSGNKIRPTASIKLNIENEEVIEADVGIGPVDAAINAVNKGIKSFADIQLEEYHVDAVTGGTDALIEVIIKLSSGDKIISARATEPDIINASVEAYIDGVNRLLENK

SEQ ID NO: 6957 - protein, 174 aa, Methanobrevibacter ruminantium
MKYNKELANLDNVEILGFKGTIESIPKTLEEIDNIRNSCCDVGTIQLMNADAIAGPKHLEHGTIHAMNAFERGDNLANDLGIEILLRTSAQRQISKAFKILGLKEGEMNIAVVMIDCPDYFIDELSNIFIRDDSVLEADESKLMKIYDIPEKELKTIHLSDILIDKTSKLIIAQ

SEQ ID NO: 6958 - protein, 337 aa, Methanobrevibacter ruminantium
MNLKFKKPSRESQMAMSKVAIGEDNIDYHNMAEEKLSNATNHQYAKLVNSGNAAILTAMNSIDGAILIPDQGAWNGFKQIANFLNKDLITVTTNQCIIDLDYLQESINQNDDNIDLDDENNKSALFLTSFAAYTAEQDIKEIAKFLHKYNILLAEDASGAICDMKGDLANGKYSDIIIGSTGSPKIINVEDGGFITTNDNSLLEKSRLILKTSKCSNITACGISHEIEYAKDNLNKTIDFTLNLKEKLNDSTDFEVFHSNKRGINLILKTNDPKSLSYKLRQEFALDSHGMITKCPNYNRLKEKAVAIEIKNLDISCLNEHNSNQIFNTIKKYEDFA

SEQ ID NO: 6959 - protein, 397 aa, Methanobrevibacter ruminantium
MRTSKATKNAYLAKLTEKIQMQSVNVGRDLDGSTPPSVFIGRWSYPKVYAGPMMVAQTGDTAIMDSPESWIGQNKTQEDIIGYRMNLVRGKQLISIKDLENPFVEKLQDISLAAKSIDSEATFGSRPSGAMFNEESMPHGPSAVIEKFDIDAVKWDRQLEKSFYDTDLKARDAVMNLHNKDVPFSAMQKAFSVGAFGIKKNRRLVPTRWSITACDSTIADSLLKEVRHYNIMDSYRVYEFSSLKNYYAIILTPTEWQYEWFEAFIKILGKEEMIFSDYETNTDKREYSCVGGCYYTAKMAVLDKLAKLKLQSGVIILREAYSGYVPLGVFNVRENIKYAMNGDYKEFESLKDSLAYCSTKLKIPISKYVKQSNLLNELLHSQQTTLDAFFKKSPDLQ

SEQ ID NO: 6960 - protein, 308 aa, Methanobrevibacter ruminantium
MLEPKEFISDAIAKIKEEIGDEKTIIALSGGVDSSVCSVLTQEAIGDNLTAVFVNHGLLREGEAEQVCSVFEERLNFKYIDASDEFLSELAGVEDPEEKRKIIGRVFIEVFEREAQAVDAKYLVQGTIAPDWIETEGEIKTHHNMALPSGMVLKVVEPVRDLYKDEVRLVGTELGLPDSIVQRQPFPGPGLGVRVVGDLTRENLAVCRAADAIVREEVEKAGLDKELWQYFAVLTDTKVTGVKGDERDFGYLVIIRLISSIDAMTATVPEMPWEVIRTISKRITSEVSEVTHVALSISDKPPSTIEFC

SEQ ID NO: 6961 - protein, 79 aa, Methanobrevibacter ruminantium
MFDNADDFKKKALDNKDELKREYINIPIGEDEQSFRISGIGEKAIKIEKYVKYDDMVDAVESGKEEGLEAVIMKFVEEY

SEQ ID NO: 6962 - protein, 188 aa, Methanobrevibacter ruminantium
MKILVINNKGQYNHRIQRTLQNLKIPSELVKNKLSISEIEEKEPIGLILGGGPSIDGVGNAAEYIKHFDIPILGICLGHQLIAKTFGGEVATSDTESYAQVKININEENPLFKGLTSPMDVWSSHKDEVHSLPEDFDIIAESSLCDIEAMKHKEKEIYGIQFHPEVHHTPKGEYIFKNFYEICQNYNE

SEQ ID NO: 6963 - protein, 315 aa, Methanobrevibacter ruminantium
MIFMENYDIIIVGAGPAGLTAGMYAGRQNSKTLIIDRGFAGGLGLEVPLMQNYPGFDLISGMELIQKMKAQTENYCEIKENETIQSIEKTEDGFLLKTRTSPLLMSEESDEIREFKAKAIILATGASHRHLNVPGEAEFLGRGVAYCATCDGMFFIDRTVLMVGGGNSAAQEALYLKNLGCNVKLVHRRDQLRCEHHLQKALEEKEIEVIWNATVEEIKGDMVVESVRLNRNGQEEDYKTDGVFIAIGDDPSNEIAKELGIDLDEDGYIITDKRQATSVEHVYSAGDITGGVKQWVVACGEGAVAAISAYNDLNL

SEQ ID NO: 6964 - protein, 615 aa, Methanobrevibacter ruminantium
MMGLEIHQQLNTKHKLFCPCSTELTDDEFDDGIIRNLRPTQSELGQIDRAALQESLRHMTFKYESFNNHTCLVEMDDEPPHALNREALDICITIASLLNMKMVDEFHTMRKQVIDGSNTGGFQRTGLAATDGYLDTPYGRVAIESLGLEEDAARRIDSDDEFTQFRLDRLGIPLAEITTDPSMHHPEQIKEVAYMIGQVLRSTNVKRGLGTIRQDVNISITRGARVEIKGVQDLDLMPEIVEREVQRQLALADIKDELIARNASVDDTIYDLDEVFKDTSSKILSKANCIKGIILRGFDGLIGKEVQPGRRFGTELSSYAKKMGVSGLFHTDELPAYGIKADEVDAMKEFLKIGPQDAIIIVAHDEDIAINALNEVIRRAEMAFDGVVEETRKALDDGNTEYMRPLPTANRMYLETDIPLFQITDDMVEPIKNNLPELPDAKKERIKAEYKLSEDLASQIVRRLLGDTFESLLARVKVDPTTVASVLVSDLRDLKRERYNVDVLTEDKLVEVFSLLEANKISKDALKDLLVEVCKNPDENVEKIAEDANLTLLSEEEVRAIIHEIAQNNESMIKERNMGAMGPLMGMSMKQLKGKADGSLVNKIVREEIQNILNG

SEQ ID NO: 6965 - protein, 435 aa, Methanobrevibacter ruminantium
MTYKEISKEFLDKANVTIGDVIKVTKEDISYEGILLDRSEDAKDAYIVIKLDSGYNVGVNIESATIELIEKGDQPKIGFEGDTIEKDPNKQNISIISTGGTVSSIIDYKTGAVHPKFTAEDLLRANPELLDLANYDVKALYNILSENMKPEYWVKAAESIADDISSGADGIVIAHGTDTMHYTSAALSFMIKTPVPIVVTGAQRSSDRPSTDAFLNIYNSCGAALSDIAEVTVLMHNSLDDGDCALHKGTKVRKMHTSRRDTFRSIDSEPIALLRDGKVKSVNLPYVKRGENELELNTDIESKVALIKSFPGISSDIIDYHIDKGYKGLLIEGTGLGHVPDYMVDSLQRANDEGIPVVMTSQCLYGTINMNVYSTGRLLQDAGVISGVDMTPECAYVKLAWALGQSDSLDEVKKIIQTNIAGELNESSSLKYFLN

SEQ ID NO: 6966 - protein, 279 aa, Methanobrevibacter ruminantium
MELTSYLSQIIISVIIFIILCLLANQVKKIIEKHYGIHLNPNDFLPIEEIKSLMQLYFLLIILLIYICIMNFFFNNFGISGELIFINSLIDIILSVFLVTIYYDGSTRGKIISIFLLPIVSISYILFGGSLIRYWDFIRIPILLYLVVIFYNKFIDYTERNNLGKTILILLSIIYTGILLTIVLEKQNPIDAVAMVTNAITSNGYAALGDSEGGVLTSVFLAWGGYIISGVATATLAADIIHRNSRKKFRNMETKIDNLENKIDNLERIIVESQKENEE

SEQ ID NO: 6967 - protein, 142 aa, Methanobrevibacter ruminantium
MADKFSKEKRSYIMSRIRGKDTKPEILVRSYLFSKGLRFRKNDKRYPGSPDVVLPKYNTVVFVHGCFWHLHEGCKHAKIPKSNVEYWEKKLYGNRDRDKRNKKELEDMGWNVITVWECNLKKDKREKTLFELYNQIISEDED

SEQ ID NO: 6968 - protein, 204 aa, Methanobrevibacter ruminantium
MVAALCTEALGKDRVIGVLMPNGVQSDIDYAKLLVSHLDIKHYIINIRDAVDGVLSQMTKSGIEISEQTRINLPPRIRMSTLYAISQSNNGRVANNCNLSEDWVGYATRYGDGAGDFSPLSNLTVSEVKEIGRSLNLPSEIVDKVPIDGLSDQSDEEKLGFTYDVLDKYIRTGEIEDKTTKERIDYLHDLNKFKLELMPSFEYK

SEQ ID NO: 6969 - protein, 497 aa, Methanobrevibacter ruminantium
MTDIKVDKNVEKAKSSQVEERVIKKPESLYDSFPRKGNDIYNTHYCAGCGHGILHKLIAEVMDELNIQDRCVMISPVGCSVFGYYYFNCGNVQTAHGRAPAVATGISRAEDNAIVMSYQGDGDLASIGLNETLQAANRGEKIAVFFVNNTVYGMTGGQMAPTTLVGERTVTCQNGRDPHYAGYPLHMCELVDNLKAPVFIERVSLANPKLIRKAKIAIKKALMIQKEGKGYSFVEVLSPCPTNIRRDVKGVEDFLINEMGKEFPVKRFRDLSKERAPVERNVSDFSIESLDKAFGVDRTKEIAEVEDDFEDCKVKIVGFGGQGVLSTGLTLAQAACSEGKEVSWYPSYGPEQRGGTSNCSVTISAKTIGSPVVEECDVLIAMNKPSLEKYSIDVKEGGTILYDSRAGNYTNDNLDVKDNVKIISIPAREIATEIGNAKAMNTAILGALMELGKDSPILSQDAFAEGIKETFAAKPKLIDINLKVLDAGAKWLRENIN

SEQ ID NO: 6970 - protein, 388 aa, Methanobrevibacter ruminantium
MSNQIVKGNTAVIIGALYAGCDCFFGYPITPASEILHEASKYFPMLGRKFVQAESEEASVNMIYGGASTGHRVMSASSGPGISLMQEGFTYLAGAELPAVIVDVMRAGPGLGNIGPEQGDYNQIVKGGGHGNYKNIVLAPNSVQEMCDLTMKAFELSNKYRNPVVVLADAVLGQMAEPLKFPEEAVEPVIDNSWSVRGSKETMNNLVTSIFLDFNQLEDFNFQIQEKYEKIRENEVVYEEYMLDDAEYVIVSYGTSSRLSRTAVDIAREKGIKLGLLRPITLFPFPEKRIKELADEGVQFISVEMSNGQLREDIKAAANYDEVHLVNRMGGNVIELKDILNEIYQMVGSDERHKVDSEDKEFDKSYLSDKDYKEELDNDNYHNHRMVD

SEQ ID NO: 6971 - protein, 84 aa, Methanobrevibacter ruminantium
MKVNQIKPYPIISKNNCKACLRCITACKEGCLKLSEEINDSGYQYAEYTGEGCIGCGDCYYTCPEPLAIEVHIPKRLRKSAGDA

SEQ ID NO: 6972 - protein, 554 aa, Methanobrevibacter ruminantium
MTSLIGNFVNRVDFKSYKDFYDNFEFNVPKDFNFGFDVVDEYARIDPDKKALIWCDDYEKRVFTFLDMKKLSNQTANFFKSQGINKGDAVLLTLKNRYEFWICMVALHKIGAIAIPTTHMVKLHDIVYRVESASIKMVVTVEEDQLLPDFEQCEKELDIELKKVLVNSFRDGWFNFDNEIAKMSEEFERPTGDEATHEDETFLIYFSSGTTGNPKMVAHAHTYAIGHLITAKYWHNVVEDGVHHTSADTGWGKAVWGNLYGQWIAGAAIFIYDYVRFNGLDLMEKIIENKVNTFCAPPTIYRFLIKEDLSQFDFSDIQYATTAGEPLPPEVFKRFKEFTGLEIKEGFGQTETTLSLATFIWMESKTGCVGKPSPAFKIGLLDEEGNPVDIGSEGEISFDVSGGRPVGLFKEYYRNQEKTDEAWYNGYYHCGDTAYVDEDGYYTFVGRNDDIIKSSGYRIGPYEVENAVISRPSVLECAITGVDDELRGQIVKATIVLAKGYKPSEELKKEIQDHVKHETAPYKYPRMVEFVEELPKTISGKIQRKIIRTRKSIY

SEQ ID NO: 6973 - protein, 186 aa, Methanobrevibacter ruminantium
MIEMSDVNKDIGMRIRELRELSDITTEDMANELDVDEETYISYEDGIIDIPASFLYQIAHIFKVDLALILTGEETRMTYFDVTRADKGFAVDRRKEYKYENLCKKFVHKKAEMFIVTVDPKEDAMPSLNSHAGQEFNYILEGTVKIFIKDNEIILNEGDSIFFDATCEHAMVALNDETAKFLAVIM

SEQ ID NO: 6974 - protein, 122 aa, Methanobrevibacter ruminantium
MVNREDCVIFKQEYGNELLVNQQYVKIRAKEEGFMSFNLRVPKEDMEGIENFFKGFKIPEPILIDIACTGNIHCYFKGISPIINKPEYSFISVSVQELKKEIVEEEQEIGIPAHECVGCGLH

SEQ ID NO: 6975 - protein, 238 aa, Methanobrevibacter ruminantium
MANIIEIKNLVKSYENGNIKALNGIDLTIEEGEFVSIIGPSGSGKSTLLNMLGALDIADSGSINVAGYDLTVNKNLNKFRGEKIGFIFQLHNLIPNISVVENIEIPMYSQGKSSKEMRKKALELLDMVDLKDKANMKPNKLSGGERQRVAIARSLANDPSIILADEPTGSLDSKTSTKILEQIHKLHKEKNITLIIVTHDMTVAKLADRVIEVLDGKILNAEESTLLDNKIEIKVNLF

SEQ ID NO: 6976 - protein, 344 aa, Methanobrevibacter ruminantium
MDLLLILSQEHDKLPLAELRAVLETEEIETELEMVCPGLVLLKELEEDVFDDYYRLLVRRLGYTHEVHQLIKTVDCSDLESEVKSIDWSEFIDENFAVRVKRFNSEIDTVDTERKIGGYILTSTDNISVNLSNPKSFIRVVAYKNTIYLCYGKYQLNKKYFEEMKPHKRPFFHPGCMSPKLARCMVNLSRVKEGDLVLDPFCGTGGILIEAGLIGAKVVGCDIDWRMKNGTATNLEYAGITDYKTHVVDIREMEMYEEADAVVTDPPYGISTTTCGEGASGIFKEFLESIEHSMKEDALLVMASPDSLDIDSLFKDVGFVLLERYAIKMHRSLTRIISVIAKID

SEQ ID NO: 6977 - protein, 432 aa, Methanobrevibacter ruminantium
MSFDYDVAIVGAGPIGSSLAYELAQNGLKVCLIDKKKRIGLPLQCAGIVNKRISSLCDIPKELILNEAKGAFIHSKNHSLTVSKKESQAYVLDRVAFDQYLFNRAREHLDTYLSSKVVDIDTELGIVQFKFDCEIKTIRSKIIVGADGPLSLSAKKVNSKLNYFNASQYLVKVDKIDEMSFVDLYAWGDLFPGFIWAIPVYSNIYRIGLFSEDDYKSQSKMLDDYLENEFRYDEYEVLEKYKGKIPIYDKSNKLFKNRLILIGDAASQVKPTTGGGILIGLESVQFAKDAILNALNTLDFDKIDFDLVGGSDSNEDDSDLNDANYKEELNNFLDELSKILENYQNDFENRFSKEFEIQFKVQKSLSTLSNDDLDYVLTKLKEKDADKLISEYGDMDNQSKLVKEFLKRGLIFSLAPKIHKKELAKIWLLNKD

SEQ ID NO: 6978 - protein, 98 aa, Methanobrevibacter ruminantium
MIFVLAKAIPKDEEACEKIVEFAQDLIENSRKEDGNIDYNLYSNTCDGTLLFVEQWESKEILGAHLQTEHFLTFGKNIADLVAAELDIAVYEAEATDL

SEQ ID NO: 6979 - protein, 227 aa, Methanobrevibacter ruminantium
MKVAVIGGTGPQGLGIAKRFAIEGVEVIVGSRKEEKALTIVEETIEELKDYDLNIVGMANEDAAKEGDILILTVPLAAQKPTLEGIKEFCTDKIVLDATVPLETAIGGKPFRFIDLMEGSAAERTAKILDGTGAKVICAFCNISNSHLSNIPNEIDCDCLIAGDDKEAKEIATELINKLPGVKAIDTGILEKSRIIEKITPLLIGLNIKYRSHYGGLRITGIPQFED

SEQ ID NO: 6980 - protein, 274 aa, Methanobrevibacter ruminantium
MIISEELFEGICDLDDFNLLKFVISSELRLKILFSLYESSKSIKELESEINRKSGNISRGLNELKSCKLITKLPNKLFAISSTGFLVAKNLENLMDNMGSIESNGEFWENHSIKSIPNKFLKELSIFNNSTLVKSTITDFAKPINLYLENIKKSTYICMILPVFSKIFNDAVNDAIIEHDGYLDLVTTKNIYDLSIKSDSDNKIKSLVRDKKIKFYIVDDLPNIFFTVSDQFASLYLFFDDVVFDNSEMLLLEDDLNLNDAYRFYRFFKNEILK

SEQ ID NO: 6981 - protein, 286 aa, Methanobrevibacter ruminantium
MTNRFEEENFLELQEDIKFLINSEIRLKILGCLYNSSASIKQIEAITNYSYSSILDNINKLEQKKFIYSIEDKFYLYNKTRLKLNSILYFNKSATFLRENSDFLNQSLIDINSEAIKDLSALEGSRLIESNNIDLFKSTEIFQRSLMGFKFLKGIFPYFHPRHDDIISYWIDNDCTVELILPDEVSEAVKNFIIDYVPKSPGIKNRFVKLKPNDHNIQLAFTVSDKCFVLALYTKSGQFNQNAVLVSTNPEAITFGLKLFEEYEELCGDYVSLENLIYPNGREDDY

SEQ ID NO: 6982 - protein, 424 aa, Methanobrevibacter ruminantium
MDDSPNEVPELNRPTKIDNIEEPKTVDELQKELDLLKAENQKTKRNLMWKVRKLEKDKILTENEKIRLERELKSLRGEVERFRSPPLVIATITEIIDDSRMTVKSSTGPSFLINYSKFLDEDLLKPGSRVALNQQTFGVVEVLPSEKDANVSGMEIEAKPDVTYDMIGGLDEQIIEVKETVELPLKHPELFEKVGIDPPKGILLYGPPGTGKTLLAKAVANETNATFIKVVASEFVKKYIGEGARMVREVFELAKEKAPSIIFIDELDAVAAQRLKSSTSGDREVQRTLMQLLAELDGFESRGDIGIIGATNRPDILDPALLRPGRFDRFIEVPAPNEDGRREILKIHTKKMNIDPEVRMSELVELTEGLSGADLKAICTEAGMFAIREERDHIIKADFEDAINKIMGKNKTGTLDDNGGVMFG

SEQ ID NO: 6983 - protein, 167 aa, Methanobrevibacter ruminantium
MNCEICGKEIEGKPLRTKIDGSVLLVCNDCAKFGRVQRDTPLERKFVTRDKKGRKEANAKTRPKKTYTRNEEPMDELVEDFNLVVRQAREAKGWKREELAAKIYEKASVINRIESGKILPDLKLARKLEKTLNIKLIEKYDDMDLEAYKSSSAGPNTLGSIVKIKRK

SEQ ID NO: 6984 - protein, 140 aa, Methanobrevibacter ruminantium
MALILIRGENNAKILNAIADVERHANLTLETKPKKVDPKFADKLVENVLKSPLRTKSKVATAFRVKEDTTIAILQVKKIHPPAHIVVVSNTYDGYRELSKIINEGKVFKGYYSNKSSSGTRMKDYKLTKTSTNEGLNIYM

SEQ ID NO: 6985 - protein, 374 aa, Methanobrevibacter ruminantium
MIIPTLGCPSNCSYCWGSEDNAELMDIDVIKQIVEWLADFRDEPVHFTFHGGEPLLAGYDFYKEALPLLNDAETHETEGFSLQSNLWLLDEEMVELFSKYNIAISTSIDGPKEINDYQRGEGYYDKTMKSVKLATDHNIQINFVCTFTSYSKDFSDEIYDFFKANGLNLKIHAALPSLRGNNADPWALPQDEHGKLLIDWLDKYLYDLDKFVIMDLDHIAKSSLRRVGTLCTFNDCMGTTLAVGHDGSIYPCYRFVGMDEYIMGNVYDKPSMETLEQSEAWEKLMEFKNFVDEDCADCKFIKFCRGGCPYNGIVATQSPRAVDPQCEAYKMIFGEVSRRANEDFKKNAMAAFGGAPRVRKEGDPFSIMDLMTKM

SEQ ID NO: 6986 - protein, 72 aa, Methanobrevibacter ruminantium
MKFEDLMAKCPKCGSQDKTAVRRFIDNHHAHAELKEFKCDNCGFVYETGKDYEDNEDETIKKGLIKELNKTM

SEQ ID NO: 6987 - protein, 348 aa, Methanobrevibacter ruminantium
MDYSIKSGIFGLVVADALGVPYEFKDKHYCDMNPMTDMIGHGTYNQEAGTWSDDSSIALATLDGLTDYEFGEDDVEGMRIKNFAEIIDYDSIAHKFADWLINKKYTPHGDVFDVGNTTSHAIYSFYAGKVDALHASGAGKKDAGNGSLMRILPVSFLIYFLSLKYDFDEEGEMEAIHNLSSITHRTLRCQMACGIYIKIAIELLKNYFDSEDDSNLLELVNNGINSAKEYYETKEEFAHELSIYEDVFSLEIQDFDRDDIKGSGYVVEALKAALWCLLNNDDYKDTALAAVNLGHDTDTTAAIAGGLAGIYYGYDNIPSNWLDKIAKSDYIGELCNNLSDYLFEILED

SEQ ID NO: 6988 - protein, 259 aa, Methanobrevibacter ruminantium
MSLEILKKGTSENFLLKQIIRKNFTSKYKDSVLGILWSFFNPLITMALLTAIFSSVFARNIENFPVYFLTGRCVIDFFNSGTKIAMTSLKKNSGILNKIFVPRYVFALGGIFSEFINFLMSMIVLIVIMIVTRAPFHLYAIFSVIPIAILFILILGVGLTLSILCTKFTDIEYLYKIFTSLLVYACAIFYPIDIVPQPIRQYMELNPIYGIIAQFREFVMYGRFPSTKLMLITFLTSIVIFIIGVIIFKKYQNRITLEL

SEQ ID NO: 6989 - protein, 409 aa, Methanobrevibacter ruminantium
MDNKNENSNKIKTQLIPSIHNTVSLQAHLTTKDGEPIVGEEVVYKLYSIDKSFLTQYSRITNEEGLVHLTLNIKHKVYIEICYEGSEKYESNNVMTFRTKPSDDEKNVKTKHPLQVQREEKLEQKKIEEKKKNLLDFQQKQKDLESVDEDNIAIELKNVNLSFTIGSDKIDNLKEYVIRTIKRTKEKKTIFKATDDVSFKIYKGEKVGLIGFNGAGKSTLLKIISGVYTPDDGEVIVNGKIAPLLSLGAGFDKNYTGRENIFLNGAILGYNEEFLNSKYDEILEFSELGQFINLPVKNYSSGMLSKLGFSIATIVEPDILILDEVLGVGDVNFKRKSREKLNSLIESNITVLLVSHTISEIRNICEKAIWLENGKIREIGEVNDICDKYLEEAKKVSDDKTKKLKPKRF

SEQ ID NO: 6990 - protein, 137 aa, Methanobrevibacter ruminantium
MNFKIKAKGHKNVLSLHKSTFEITKDKDLSLSGDCIIGLDIDKCMLDFPKEFKEKLANDETIVTVKLKSPNAYDEIVGYGHHDLTLDHPTDIVCRKSDFICSRTLMIKSDKAAIDLNRDLIEDLANGESLDVEIILS

SEQ ID NO: 6991 - protein, 312 aa, Methanobrevibacter ruminantium
MIINTGLRTDIPGFFSKWFYNRIEEEYVYVRNPYYKSQVFHYKLNPELVDCIIFCTKNPKPMLSNLDKISEFNQFWFVTITPYKKEIEPNVPSVNKVIKSFKELSSQTGKESVSLRYDPILINDKYTLDYHIEAFEKIASSLSDHTSEIIISFIDLYEKTKRNFPQAREVSKEERLIIGKEFSNIARENNLILKTCVEGKELDKFGIDSSGCMTKEVIERAIHNKLDVRVKKSRNRPCDCLLNNDIGEYNTCNHGCLYCYANSNKQLVKRNFKRHDPDSPILIGNIREEDEIKEINQESFLIHEDTVQTKLF

SEQ ID NO: 6992 - protein, 152 aa, Methanobrevibacter ruminantium
MKGTYCLIISMKKSDKIKIGNLYPEAYKFKKGYYVYIGSAMNSLISRLNRHLSDDKKMHWHIDYLLTSEYSEIREILFTDSEKRIECDLANEIAEDGLEIEGFGCSDCNCNSHLIFFNRKRDALRRVKDAYESLGIEYYDLKYFRTIDNKKD

SEQ ID NO: 6993 - protein, 960 aa, Methanobrevibacter ruminantium
MKIIFKRCLVLISLIFILILTLGLVSASNNINQINDMNCSVYEDYSENIITADLNSNSNELNSDFAYGDSDSEEILDEPSQKLKTGSDNSDFKDIQNLIDNAKENDVIELSGTYTGDSLIVVNKSLTLKSSSSATLDGEFLNELMAINAPNVILDNINFINANYTGLSVNNNYVTIQNCNFDGCINGELGCALIIHGNNVNVLNSNFTNNVANKSSCHHTDGAAIYLIGNDCQIDNCSFINNWGYNFETSSSGGAIWIKGNNIVINNSYFFNNSATAEVGWTFHGEEITYLADGYGGAAFLVGKNVKIINSLFDSSLSHAQGGALYYKSAYDCSIINSTFLNSFSVGEGGVIYLGQNIDGLMIDSCNFINNTADGLDGVLVKYTDLGSVLYASKFAENVVITNSSLLNNKGTSAVYFLGNNLNISNSIIENNNLSTAVIYMNGSMNDNFWSKNFDSADEFKNDCFIIRDNESQVPDTWFNLVCDGLDSLKAKGVYDYNMSFVLKDASLDNHASKISLTNNLPNYHINLKNSAKNKINPNELVIVDNQADFTYDYIESAKDSIDVYDDYNNLILSKKVLSGITYINDSGNDTKDLQDAIDSASSGSLISLSNKTYVLDTILINKDIHISGEENTTVMLSNSSDYIFKISNCSAANYSDYGIAISNINFILDNGDIVALAEAVNGSGSLSIDVASIKITDNSFTSREGVVRESITILELDSQRAVLAPTRNISISNNSLEIGMNPFDFNVKSVINGSDVRVDVGGNLASKKASQIICKDMVTKAIASNVDSRSGEYFNVSLKDSQGKPLQNKFVQIGFNGAVYNRTTNESGELRLQINLAYKGVYTFAISYLGDDECNGSFEVAKITVNPQSPILMANNAKYKVSSTKTLSASFKSMKGSPISGKTIKFTVDGKTYSGKTNSNGIASVKVSLNKKGTYKFTAKFAGDNTFAAVTKSAKVVIS

SEQ ID NO: 6994 - protein, 267 aa, Methanobrevibacter ruminantium
MKRQKKIAIYGKGGIGKSTTVANIAAAYSEDNKKVMVIGCDPKSDTTRTLCGKRIPTIVHTLKDNKKPELDDLVFEGFNKIKCVESGGPEPGVGCAGRGVIVAMKRLENLNAFEEEFDVILYDVLGDVVCGGFSVPLREDYADEVFIVSSGEYMSLYAANNISRGIKKLKGNLGGIICNCKGIDNEEEIVNSFAKEIGTQVIGVIGRSNLIQRSELDAKTVVEYAPESIESDAYRKLAKDIFDNDNYSTPQPMEDEDFENFFKSFID

SEQ ID NO: 6995 - protein, 419 aa, Methanobrevibacter ruminantium
MVELLAPAGNFISLSSALKNGADAVYIGLEDLNMRVNASNFSLEDIKKASEMTKEYGAKLYVCTNTIMKDKDIEMLKDQLPYIKEYGADGIILSDISLIELASQNGLEAHVSVQENTTNFYALKTLERLGAKRAILSRELSLDEIKEITRKLKESDSTIETEVFIHGAMCMAISGRCFLSYGLYGRSANCGDCLQPCRKEWKLSFEENEDDDVINFSDCDDESFIISQSYDDSYRTNFFSPKDMALIEHIPELIEAGIDSFKIEGRARSPDYVAAAVSVYRQAIDLYYDDPDNWQFNPEWMEELMKVFNRGYDTGFYFDTPYEISENNQSKFIKRDIGKVVNYYNKIRVAELKIWDDLALGEEIMIQGPTTGSITHVIESMQIDGKSIEKAEKGSNVAIAIDEKLRESDFVYKLVPREE

SEQ ID NO: 6996 - protein, 480 aa, Methanobrevibacter ruminantium
MKDKCGIVGIHSKDSSKDVSHLIYYGLYALQHRGQESAGIATYNINYGLNFHCGMGLVTDVFNNSLINSLSGNVGIGHVRYSTTGQSKIENSQPFFTELDDGFIAMAHNGDIVNSGSLRDELTKKGYQFKSGTDSEVVCYLIKEAYEKDKDILNVIDAVSQKLIGSYSLVILINDELYVLRDPMAMKPLILGQTNDHFVVASESVAFDVIDAEIIRDMAPGELLYFKNNEINSYILPSAKGSRRAHCMFEYVYFARPDSVIDDRSVYNTRLRIGEALFKENPIDADLVLPVPDSSIPAAIGYSRASGIPYGEGLIKNRYVGRTFIMPTQEEREIAVRLKLNPLKHELVGKRVVVIDDSIVRGTTSESLVRILKAAGAKEVHMLIGCPPVIAPCYYGVALATKDELIAANLEIEEIRKQLGADTLGYISIESLIEAIGIDGDSLCLGCITEDYPTEIPEDLEAESYYDYYQDLKDAVEEDE

SEQ ID NO: 6997 - protein, 470 aa, Methanobrevibacter ruminantium
MNNDFESDEFNSNDNNNNDFESKLVDIRIVLTDLNYIEAISKAVSNFDLSNFNVNISSIIPSSDIEIAKNTIIGADLVLIATSSDFEGKELYSNFKRALKTDYNFVEYLKLPSLDELEDYDYDYDEDNTFEDEIANSIIRAGLYSISNLSSINKSKKAYYNVKKDFDDSRLRFEKITKENDILLNESKQIREKNEKLREEVKILQKDLDNIKSDYSDLKSRFESIHSKNSLEVFSLMELWQDLFNETFTEEIYRFILISTDNFRPKNLMIGQGAICAESKEDAMDWLKIIKTAFILSDTNKQELNFNNFNSNFKFEDLDSNISSSQNLDSNISNTRYDLDSNDSNLFSSLDSNIFNAHNSDSSDEFIYNERFEGNNNSQEEFRQLDFDDAFDLNDNEGQESFNQNDLDNSYNSKDDPSDEINVFNLKSLKGFREESDEDESDENGDYSYDEDDDLDEADDLFNPFSNIWD

SEQ ID NO: 6998 - protein, 396 aa, Methanobrevibacter ruminantium
MIKTDVLVIGAGPAGSSAARFAAKGGVDVILMDKKSEIGAPKRCAEGVSKKTFDKLDLEMDPHWVTQEIAGVRLVAPDGTDVWLDEDVIDLPEAGYILERKVFDKHMAMEAGREGAQIKIKTQAKGLKREEDGSFTVTCESMGETFDINAKIIIGADGPESHVARWAGLKAYTKPKHMEAGVQFEMCNAKMEKSNVLEFYFGSVAPGGYFWLFPKGDDIVNAGLAIIPDMAGDKSAYEYLVDAVNNCYATKDAQPVELNVGGDPVGGLVKEMYGDNIMLCGDAASQVNPLTGGGITNGMMGGRFAGEVAAEAIKAGDCSKDFLKKYEDLVKEEMGHEMQKYTKVCDYLWTLDDDDLNSIAHAFQDMEFTKISTTELVKAVIKVQPKAALKLGKLFL

SEQ ID NO: 6999 - protein, 54 aa, Methanobrevibacter ruminantium
MIVKDWCSYCGCCAGVCARNCIEVKETALVISDDCNDCGICVKACPLAALELEE

SEQ ID NO: 7000 - protein, 201 aa, Methanobrevibacter ruminantium
MPSFLNIRGNNHDPKDPQLIRDGIKLGVNYKRFSKEPVLGKNILLRSNTVIYNDVIIGDDFKTGHNVVVRDHTTIGDDVLIGTNTVIEGGCKIGSNVSIQSNVYIPRNSIIEDNVFVGPCACFTNDRYPVRVEYDLKGPQLRKGCSVGGNTTFLSNIEVGEGAIVAAGAVVTRSVPPYYLAIGTPAKIKPLPTSLRVPNMI

SEQ ID NO: 7001 - protein, 103 aa, Methanobrevibacter ruminantium
MTKHVCPRCGSTNVEWIIPQNWSKWECRDCSYTGPIIDADDDLIAEIKADWEENKEKYIEEEYARAEQMASGEDERLDEEMEIAEEDELSDEELDKKLEELDL

SEQ ID NO: 7002 - protein, 386 aa, Methanobrevibacter ruminantium
MVYDVSALLSHINRIRREIGHEEVNIEIKEVLYNIETNEMWIITNDRPDKSAVIGKGGWVVGRLREELQINSIHVESYSDFLTKEYRMGLSLNKLKSFVTTEDLSDDVKLSLYNLIDLLTIKSDNLYSFDFKSYFDDLENGPYSYFEAEKPVAIVALSGGTDSSFSLILAKKLGFNPIAVTVDPGTIVLPNQFKYNIDKLTSKLDVKHEYIPVAYDDIIEDSLAGRFHPCGRCSKRIEETLFKYAVDNDIPMVIFGDMLSTGSQCITEQFYGENSEDSVSQDLEDSVSSDLEDSFNTELEDSINHKLIRLNLPAALAVSKLENKALTSHYELNKFKGFGCPLLYEVHKKFPHMKKYSIQRILRETRSSALEPGEALDLIWSFYKTD

SEQ ID NO: 7003 - protein, 472 aa, Methanobrevibacter ruminantium
MKIRTGRLEKEMTDEAAVYTSSLEFDRFIFDADIRCNYAHTSMLKAQGIIDSEIADKILDALDKLSEEGFDALEFDHSVEDVHMAVENYVTKLVGPEAGFMHTAKSRNDQVATDIRLLLRDRISEIQIAILEFIEGILELAKEHKETVMIGYTHLQHAQPITLAHHLMAHAQALKRDYQRLDDTYKRVNLNPLGSAAMATTSFPIDRELTTRLLGFDDYLENSMDGVSSRDHIAEAVFDLTALCTTLSKICEELVLWSTYEFGIVSMADEYSSTSSIMPQKKNPDVAEVARSKCAIVNGELMTILTILKAIPYTYNRDLQEITPHLWNACDVAYDTLKITNHMLLTVTFNTERCLELAGANFATATDLADIMVRERKIPFRTAHKIVGRIVNEAVAEGLNPSEIDGAYVDNVADELGFDKLNLDDDLIHNALNPIENVKIRNVPGGPSPEMVQLAIDNMNIFLDVEFEKQGI

SEQ ID NO: 7004 - protein, 52 aa, Methanobrevibacter ruminantium
MATKKELYTVEGDKIVRKNPFCPRCSEGVFMADHGDRYACGKCGYTEMKTKE

SEQ ID NO: 7005 - protein, 104 aa, Methanobrevibacter ruminantium
MEIEITEKKENILFDRTEVKFNCLYEGEATPKLLDVKSKLVALLDTKKELIVVDNIQPGYGEPKATGYAKVYGREASLLDVEKPSVIAKNKEPEAPAEEEDEAE

SEQ ID NO: 7006 - protein, 166 aa, Methanobrevibacter ruminantium
MFRIDENSIDEFKKPLGVLYPDFEDAIPMIKEASFLISVGDQTIKNLLDNDLYPNLGIIDNRIQRKDHNHDIIRTENILKADNPAGTITEDLWETIELAISSILEDEDTRIIEVKGEEDLAVLPCLLIAPEDAVILYGQPNEGLVFVNVFEAKDKATRLMTFFNKE

SEQ ID NO: 7007 - protein, 60 aa, Methanobrevibacter ruminantium
MALQACTHCNLLTEKQQCPECKNPTSTNWSGLLIITDPENSDIARELGIKKAGEYALRVR

SEQ ID NO: 7008 - protein, 189 aa, Methanobrevibacter ruminantium
MTTIEGTVRIPPHRFGEPLEDVAIETLNESYNGQLDKNLGLIVGVTSIEEMGEGVLIMGDGAAYHNVIFNAIFFKPEQQEVVEGEVIDIAEFGAFVRIGPMDGLVHVSQVTDDYINYDPRNASLIAKESKKILTEGDRVRARIVTLSLKGKTVQESKIGLTMRQPNLGKFEWIEKEKAKALEKKMAKVE

SEQ ID NO: 7009 - protein, 133 aa, Methanobrevibacter ruminantium
MKSESREVFIDTNFFMIPFQFNVDIIEEFKRVLPNYKLVTTTFVIDELKGLKNNNKGKVRLAAGLGLRIAQSDEIEIRNVSLNDGESVDDALIRISKVLATNDIVLKKKAKKNGIALVFLRQKKYLAVDGYLA

SEQ ID NO: 7010 - protein, 407 aa, Methanobrevibacter ruminantium
MKVQSDVNIGLVGHVDHGKTTLTKALSGVWTDTHSEETKRGISIRLGYADIEFRKCPNCEEPLCYTTKEVCEHCGSETELIKKVSFVDAPGHETLMATMLSGAAIMDGAVLVIAANEECPQPQTKEHLMALDVIGVKDVVVVQNKVDIVPRERAIESYKEIKEFVKGTCAEDAPIIPVSAQQGANIDILIKAIDETIVTPEKDLDKPARMHVARSFDINKPGSHPDKIKGGVIGGSLTQGTLKIGDTIEIRPGINVKENKQNKWISLSSEIIGLQAGGEAVEEVGPGGLIGVATKLDPALTKADSLSGSVAGMEGTLPDVLHSFDMKTELLERVVGTKEERDVDPIKLKELLMINCGTTTTVGIVTSVKKNISVDLKLPVCADKGDRVALSRRVGARWRLIGFGIIQ

SEQ ID NO: 7011 - protein, 129 aa, Methanobrevibacter ruminantium
MAFKIVVSEKELSYQLEVEEAKQLNGLTIGEEFDGQIVGLDGYTLKITGGSDKNGFAMKRDVDGPRRIKSLLTGGVGYNPKVDGVKRRKTVRGNTISEDIVQINTIVTKAGSKSIPEILNPEEEEEAEE

SEQ ID NO: 7012 - protein, 596 aa, Methanobrevibacter ruminantium
MKIRSPIVSVLGHVDHGKTTLLDYIRGSTVADREAGGITQHIGATEIPIDTINEICGEFISKLAIKDTIPGLFFVDTPGHAAFTSLRKRGGALADLAILIVDINEGFKPQTYEAINILKMYKTPFIVVANKIDRLFGWETHEGASFMESYNKQAPRIKSDLDLKIYELMGKLHEEGFQSERFDHVTDFASQISIVPICAKSGEGVIELIALLLGLAQQYLTQQLEISEDAPAKGTVLEVKEEVGLGITVDSIIYDGVIRDGDEIALMDANNVVTTKIRSILRPLPLEEMRDSKNKFKKVDEVVAAAGIKIAAPNLDDVVSGSPLRVLSDQEDVEAELLKELEDITVDTDDEGILVKADTLGSLEAVVHLLKEMDLPIRSAEIGDISKRDVINASIAMDENEEYGVIIAFNVKVHPKAEDDLKNSGVKLFAGDVIYQITEDYEAWIEERKEAQKKQWLDAIIKPAKIMILPKLIFRQSKPAICGIEVEAGTIKTGYSLMDANGDYVGVVASMEDKGETLQAMPRGQRVAMAINDAVAGKDFEEGDSLYVDIPEKHFKVLEREFKDKLTEDEFLALDEIVEIKRKRDSDWGKLGLFEY

SEQ ID NO: 7013 - protein, 150 aa, Methanobrevibacter ruminantium
MIERSFVMMKPDAVSRRLMGQILSRFEDKGLKIVAMKLRQIDEDLAKEHHGEHKEKPFFGGLVEYITSSPALTMVIEGDDAISVIRKMVGATNPKEADIGTIRGDFGMDTGRNIIHASDAPESAAREIALFFDEEEICDYSMSDNAWIYE

SEQ ID NO: 7014 - protein, 53 aa, Methanobrevibacter ruminantium
MRTCSFCGKEIEEGTGKMYVKRDGTIYFFCSSKCEKNMIKLGRVPRKVKWVKQ

SEQ ID NO: 7015 - protein, 68 aa, Methanobrevibacter ruminantium
MEEGSPAEVIEVLHRTGMTGEIMQVKCRILEGRDKGRILTRNIMGPVREGDILMLLDTIREAKEIRTP

SEQ ID NO: 7016 - protein, 135 aa, Methanobrevibacter ruminantium
MDGKSQMKKEVNYMANIYVKFDTPEEIANKAEEALEVAQNTGKVAKGTNEVTKFIERGNAALVVIAEDVDPAEIVAHIPVLAEEKEIPYVYLATKDKVGAAAGLSVGTASACIVDAGDAADLVEEVVEKVAELKE

SEQ ID NO: 7017 - protein, 65 aa, Methanobrevibacter ruminantium
MELPIAPIGRILKNAGAERVADAAKEELAEAIEEYGNEIAQKAVNFARHAGRKTVKAEDIKLAIK

SEQ ID NO: 7018 - protein, 398 aa, Methanobrevibacter ruminantium
MIRCVSCGEEYEDDEVIYNCKKCGSVLEVEMEVDVPKSTFEGRRDNLWKYKECLPVDADKRVSLDEGGTPFCRCEKLGKELGIDLYVKVEGSNPTGSFKDRGMTIGMTKAMMLGVDTVGCASTGNTSASLAAYAARAGLRCAVFLPAGKVALGKLAQAMFHGAEVFSINGNFDEALEAMTQLAREKYLYLLNSINPFRLEGQKTIGYEIVHDLGWESPDRIVLPVGNAGNISAIWKGITEFHNAGFMDDVPMMTGIQAEGACPIANAYRDNTMDMVPVENPETIATAIRIGAPVSAVKALRAIYDSNGMAETVTDEEILAAQKLLARTEGVGVEPASAASIAGLKKLVEQGDVDKGERVVCVVTGHLLKDPNTAIDACVDPVQVDADIDKIKEILLNK

SEQ ID NO: 7019 - protein, 363 aa, Methanobrevibacter ruminantium
MIDPWASFSLDYDKLVNQFGIKKFEEVLDSIEDPARLMKRGVIFGHRDFDKLVPLINGGKDFAVMTGMMPSGQMHIGHKMVIDQLNWYFKKGASLSLSIADMESYAARGISFNQAKDIAINEYLKNYIALGLDLTADNVNVYLQSQNKTLNDLTFKLAKKVNFNNMHAIYGFNESTNIAHLYVPLVQVADILLPQTEEFGGPKQVVVPVGVDQDPHLRLTRDIAAKMNEEYGFLAPASTYHRFLTGLTGDKMSSSKPNTAIYLNETPKQAEKKVKSSKTGGRETLDEQKELGGRPDECVIYEMLVYHLIDDDKELDKIREECINGELMCGHCKVHTAELMKDFFEDLKVKQEESLDIAESLLD

SEQ ID NO: 7020 - protein, 171 aa, Methanobrevibacter ruminantium
MRGDLSDGIVTVKIGEGNERAISLNQKSQFGKLSEDCLELSLMEASYLMESGRLDIYEDDEKCQLDYIIDMIKDQDLYGKYLVYRDLKNRGYIIKTGFKYGSEFRLYERGTGPGKSHSDFLVKVLYEANEVNVLDFASYVRVSHGVNKKLLLAVVDDDFDVTYYNIEWTRP

SEQ ID NO: 7021 - protein, 217 aa, Methanobrevibacter ruminantium
MAREISENIEEYLETLYKFGSKDSYVSTTTLSKELGIAPGSVTQMLKKLEDIGYIDYVPYKGAFLTAEGNKIAQKITRKHRILEKFLKDVLNIKDENLHAQACAMEHSLSDEAERAICHMLEHPDTCPDDNIIPACDFNFESCEDCLNDHLDFDDIEERDFNLFSISQLSKGDEGEVLFIRGSDDALAQCVRVGITVGSKVKIEESESPNFLFYHSK

SEQ ID NO: 7022 - protein, 115 aa, Methanobrevibacter ruminantium
MSRTWSFYKSFKNLIVGVNIRTKLLFLSALLILLLSISSVSADSSIDDSNLDIDSNLGIDSNLDLNADLYADLNNFDDFNNLNNYDYSNNYVDYSDILEGDSLIWKLKRIIILIN

SEQ ID NO: 7023 - protein, 1010 aa, Methanobrevibacter ruminantium
MLLAVLLMGFVLISSVSAIDIDEASSSSDLSDSSISNDYLVANSGDDSVASSSASSSIAADDSDLSNNASSSNVNFENEVLSTNNNEDTESEIVKDSKNQLSSSSLQASTKTKTTLKGSGSSVYRGNPYYVTLTDSNGKVLASQKVTFNILGKNYTRTTDSKGVASININLAKGKYNIACLYAGTENYASSKLSVALTVNLMSTKINTGGSTVKKGNAYSVTLTDGNGKALSSQKVTLNILGKNYTRTTDSKGVASIAINLAAGKKFTLTASYAGSANYLSSKVSATVTVQKGDTSIKPSGTSIVKGNSYSFTLVDGSGKGLANQKVAIKISGKSYSRTTNSNGVASIAINLAAGKKYSIVCSYAGSSNYKASSSTVSLSVTNPSTNSKTFSIAKIEAAATNLKAYVNKNKAVPTTVSVGGTNLKISEFSYLMSKAIVNLNSNNTNAITLPSGIYNGASASNSLNATVYKAQYVDLSKRVYNYIDKNKVPAAYGTVYNANGASLGNAGFNLYTFAFAKILDFHKTNKYLPNYCSFDSSVFKASNGSSSSNSSSSTNSSSSTNSSSGSSNSSGSGSSTPAVTVKATSLKAASTSVIRGDDYSVTLTDSSGNALANQKITFALSSSSYTRTTNSKGVASLTLNLAGGKYSITTSYAGTSAYKASKLTNTVTISNSSSRFFLNDIETAAENVKTYVTKNKALPNTVTVAGTQLTLSQFSYVMAKAIHNINASNSNYISLKSVASSNSTGDYLDTTVYRAQYMNLTNRVISFVESDKITPTFATVYNSNGKSVGKAEFKLYTFAFAKILAFYKTNNYLPTYCTFQSSAIGVVPDVATNVTINSKINANMNQFKVGLNEKNTVSNLSAYLVGTGQSTITTNIKNVAAQLTKGLNSTATKALAIYNFVRDDISYSYYSDSRKGADGTLSSGSGNCVDQASLVVALCRAAGIPARYSHAQGCTFSSGLVTGHVWAQILVDGVWYSADATSVRNSLGNIVNWNTNSYHSMKQYAAVPF

SEQ ID NO: 7024 - protein, 1298 aa, Methanobrevibacter ruminantium
MEDNLLKNRKLILISIFLVSLLAISAVSANEDVDNGLIDSDDSILQSAEVSDSAIGSDSILQSAEVSDSTIESDSIELEDKGNVLKSSDNASFELDDKNNIGSADSELEDDYLEPKEKNVLSMDENAWFYNYIVWYDGDDGDWVSLDFVDDLKNPENITIRLNSYDTPFDGVDLAVINDYDYSITKLTTDDNGTVVYNVPYEVDELSVFVGFWYDGDFVATYGNWESYTICAVNWGTWYRDPSKRTYDFYVSVSDMDTYESPIGAQVVFTSDSNQYVGTIDENERAIIPKVSYGTYDVKVIYDGYCILNLSDSSAIEFYDDHHTDPDSLGDERIDYMYVDSSGVVYLDLCYDGSLKVPDNSTYEPYGDDNPSGGGSGNQSGGTVANGTFTSLQSLFNRAAANSTISLTRDYVYDDGFDIKGIVINKDLTINGNAHTLDALGKSRIFYVNNSTVKFNNILFANGNATLGGAIYNGSAVNCLFINNTAQDGGAIYYGSALVCDFINNSASRNGGAIYSGGAVNCSFINNSANLGGAAIYDSLFAVNSTFVGNTLASSNPTGGSATTDVSVVSFNPITTYIPSPPSMTGSIGWGGAVLDFTRPVIYTDYNETFYLLTNFTLQQDGFNNYGNVQLTGRDLVFKSLYPYSGNYSMALIISGQIFTPTYVLGENDTYEAHFKLNGLSLGLHMVYAYVDFGYPEYYSYRIGGGYMDRVAYDRTAEIIFPILINKTVEISSSNLNKYYGGTGKYTVTLTDGGNPIANANLNVSLAGKTYPLKTNANGQASMDINLTPGTYEAVCTYDGVSQRSNIIVRSTINLQNLTGIYQNAKVNATFLNAAGSPLANTKVSFRVGSKTYSATTNANGLATANVDLAAGTYDVIAINPVNNEQKTSKLTISKAKSSISLSSTSNNDKVTLTASLSPSTASGNVTFNLNNKNYTAKISSGKASQTITGLNEGNYTANAYYSGDSNLNSSSASTKVVVKIVIPTKIIYKNMTTGPVAKSDGRIGNYFCVKLVDGSNNALTGLPIKIGFNGKIYDRTTDSNGEARLQINLANADIYTFAICYLGDDDHQASFEVAKIDVNKKYPKPNSANGNSNGVPAQETISNTKLKTYIQYSNMTTKSVLKSDGRVGDYFEVKLLDNNKKAMANVPIKIGFNGKIYDRTTDSNGGAKLQINLLKPTTYTFAIAYLGDSKYQASFEVAKIVVKAQSPKLTAPKKTFKANAKTKSVSATLISERGKPMASQSLKFTINGKTYTAKTNSNGVATVNISLNKKGTYSCTVKFAGVTGANAKTTKTTIKIS

SEQ ID NO: 7025 - protein, 549 aa, Methanobrevibacter ruminantium
MAQINQPMYILRDDTERFQGRQALRMNIFASQLLASIVRTTLGPKGMDKMLVDKMGDVVVTNDGATILQEMDIAHPAAKMLVEIARKQENVVGDGTTTVVIIAGELLKKAQELMEDGTPVPTILMGYRLAVAKAMEILFDISFDARDKDTLFGIAKTAMTGKGSDYAKDELAELLVQAVKKVEEGEEVDKTLIKIHRINGGSVEDSKIVDGIFIDQGRANETMPKEIHDAKIALMKYPLELKDLENAKVDFTDPLQMQIFLDNEQEMLKEIADKIIDSGCNVLFCQKGIDDVVQHYLSKEGIMAFKRVKNTDVKRIMKATGAELITNIEDLTPDVLGKADYIHQERVFDQILTFIEGCDEPKASSILIRGSTRHISSEIERAMEDALGVVAATIEEGKVVSGGGSPEIEIARQLRLYANSIGGREQLAIIAFADALEIVPRTLSENAGLNTIDLLVELRAAHEDNPYMGLDVFEGKVVDMKEAGVIEPQKVKKQAIQSAQEACEMILRIDDLVAAAGALQKPDPDENLDNSGMPPAPGMGGMGGMPPMM

SEQ ID NO: 7026 - protein, 259 aa, Methanobrevibacter ruminantium
MNLEGVEKTMLLTLYTKAKHSQKPNHKFFDYMAIDIISEIDYDFSIADKDRSMQMGVISRTIVLDDMVSEYIRSHPKCTIVNIASGMDTRFNRLDNGIIKWYNVDLENSANFRLNYIKDTERVKTLAYSAMDPSWAEEIEASGDVLFIIEGLTMYLTEVENKQILDIIDENFKSCTIFTEIMPPVSVENVKEKSVEEMDAKFIWGVQDGFELRRLNPRFNWVKDVNLFDGMNVYKPITKLFTWIPFIRRRMDFIAVLEK

SEQ ID NO: 7027 - protein, 324 aa, Methanobrevibacter ruminantium
MMRKNDRSSINPFTGKEHYDTVDDDKFLEGCFQGYYQELQRSQLLDNTPEGQFIVQVAVKLINTVNEFLTKIGRQDYVEGYYEWDVHLVANNSVNACCMPGGKIIVYSGIFSIANTEERMAFILAHEMAHALLDHGRTRASAQSTKNTAASVAWVGSFALDMVGLGGLGSLARAATNIASVGSQYFLLQPWGRDHEFEADKLGMIICHLAGYDIREVPKFWKEFAGDKASNFDFFSTHPSDAKRIEVMEASEIEILNTTDFYSKPVLPETPKATGERKNTNAKPQEPQAKAVADNKSTHFCTNCGSEVAPDDNFCTNCGAKIGK

SEQ ID NO: 7028 - protein, 66 aa, Methanobrevibacter ruminantium
MIEEHNQKSVEELVENFSYVYVYFADGRSIRISKEKKFEFKDNKFYIYDKDIEVNIVDIELIEFTD

SEQ ID NO: 7029 - protein, 406 aa, Methanobrevibacter ruminantium
MKADAYKIVDNVYWVGVLDWDIRDYHGYTLDGTTYNCYLVFGEDKVALIDNVYPGKSEQFWGRIKDAFEKEGREFKIDVVVQNHIENDHSGSLGEVVAKFPDVEVYCSKKAEPGLKNHLPELEDFEFNTVKTGDTLDIGGKTFQFVNAPMLHWPDSMFTMLMEDGILFSNDAFGQHICVSERLDTDVDPVILTDAARKYYANLITLASPMVGRKIDELAELGIVDNLKMIAPCHGQIFTNPEFIIDLYQKWSTGSYEGNKITFIYDTMHHSTQRMAHAMAEGVMSEGVKVKMYFMHDDDKSDAVTDVLDSKAIFVGAPTMMNNPFPGIGDVMYYLNCLSFGNIEKKKAVVFGSKGWAGGSARILAANLEGAGFEVVEQMEIDFKPNEEILEECYELGKKVAQLIKE

SEQ ID NO: 7030 - protein, 280 aa, Methanobrevibacter ruminantium
MSLKYFNNLTYEEIGEYNDKIVLFLHPKLLSHWIWKKQIEEYDKYFNNYHCIFIDLPHHGESKFDGKFSIEESSDILIEFIKHLLNNKKSESINIVAIGLGASIAIEILNKETHLINHIILSGLEIAQIREKEEETIIKRLAKTKAEYLNMKPDQFIIKAYLRYYGIRKEYYDDLEKSLDIPIRKEEEIAYKSLNYIIPDFSKETIEKDNILLVYGNKDNFNSTKSAIKLKKLFFNAKLIEIEKGNHLWNIIDYELFNQVIINFIQKEIIFNDERIKEID

SEQ ID NO: 7031 - protein, 304 aa, Methanobrevibacter ruminantium
MKIGVIGYGNMGSMIANNILELNLLLADEELIVSNRHIEKIEELIERYPDGKVQITDDNTELAKSCEKIIISVTTPNFKEVLDEITPFINEKTHIIYTCAGLDFEHISSFYDGKLSLVIPSLASTVTSNNAISSIGRRKGITLIKHNEKVDIQDSYFLEDLFNEFSYVRTLKDHNFFFEENGNLASNNPKLEICTILTSCSPAFIALMIDNFAERISNISDLSKDEAEDMILKTVIGTAILKEDKKISNSEIIEKVATEGGITAEGIDLLDKRLNSIYKKLINTLLNRYEEVSKEMDELYLKDN

SEQ ID NO: 7032 - protein, 112 aa, Methanobrevibacter ruminantium
MNPKQLKKMERQMKKMGMDMKSIDDVEEVIIRCADKEIIITNADVSAMNVMGQETYQVTGTAVEVEREVELVIPDEDIEMVASTAGVSVEAAEEALRECGGDLAEAIMKLSN

SEQ ID NO: 7033 - protein, 666 aa, Methanobrevibacter ruminantium
MFEIKAKDMRGRVGVLKTNHGEIKTPNLMPVIHPRKQTVDVKEYGADIVITNAYLIYKDEELSKKALDVGLHELINFDGPIMTDSGSFQLSVYGDVDITNKEVIEFQEAIGTDIGTSLDIPTGPYVDREKAEEDLEITIERAKEAISYVKDNDYEMKINSVVQGSTYPDLREYCATELTKLDADLYPIGAVVPLMEMYHYRDLVDAVMHSVKCLPDSKARHLMGAGHPMIFALCVAMGCDLFDSAAYILYAEADRLLTTRGTVKLENLNEMPCSCEVCCKYTPDDLRAMDKEERVQLIAQHNLHVSFAELRLIRQAIYEGSLMELVEERCRAHPMLLDGLRHLGEYSFDLEKYDPRSKKSAFFYTGPESLKRAEVTRHLNKLNEMDKRKNLVVLPTYTKPYTKHLTNSFNELFVYAKDESLSEDAECKIENGETDFMVLDTPFCLIPLELDEVYPLSQSDAPRIRDKMAIEFARDFLIDFAEDYDNVLIHPNVLEELELDYIEEYNYPEEIKFEKDDIKKLKAIADYQFGNGAGDALFTGKIKIEKSKKTGKIRHVYDKNQIIVNMRASDSFLILSKLGAKRLAAIEGMRNKVMIDNSVESFARDGKSVFAKFIKDCDENIRSNDEVLIVNEQGELLAFGKALLNYSEMLDFNTGQAIKTRKGFKD

SEQ ID NO: 7034 - protein, 617 aa, Methanobrevibacter ruminantium
MKINSFRVLLFIIIISLSFIGFSTISAVDLSDSCCDTLISDGSDGIILGGSDDISLSDENNNLNFDLNDNPDFNLDYDSNSYPNLNLSSNSNSKSSSNTYGNDFTLSRFKSVLTSSYNLNGGSFEDIQSAINHAADGDDIILNGTFTTTGSVIVINKTLTIIGSPNAVLDAKNISKIFLVEADGVNLKNLTFINGKSRNESDNGPYQGTVNWQGSNGTIVNCSFINNSGDEKSYGASILWKGSYGKISDSIFKNSYSGANGGAIFALGENLTINNSEFINNHGKEGGAIYFGGSSAMWIINSIFINNSADSGGALAACAMNRQVINSKFIGNSANNGGSISWCGSNGLISNSTFINNSADQKGGSILFTGTNNLVKGSVFINSSANIGGAINSLNRLNYINDLRFENNNASLGEDCYGDLEFKRFSTSIASEDMVTSAIDANLDGRNGEYFNVSLKDEYGNPLINKDIKIGFNGRIYNRTTDSNGQASLQINLKYSMVYTFAICFLGNDDFYGSFTVSKITVKTQKPNLEVNNFKYKSSTKSKVIKATLKSSRNNPIQGKTISFTVNNKVYTAKTDSKGIASVNVSLSSKKTYAFTVKYAGDDTYSSVSKSANILVY

SEQ ID NO: 7035 - protein, 407 aa, Methanobrevibacter ruminantium
MTYIEEATVIDDTIYDLINEAFENERKYNDPVYRNSIFKGHKEYFVKTDDGSYSIKSKEINNKVETLHTSTGAISESFEKFIKPLKLDYSQDIAILDICAGLGYNTSAAIDDFMKNSTEDANLQIDLLEISKPTLAAGLMVPSPIKAHDITKKAIEDALIAEDYASLSLEEESIPDNINLNIFIDDARKVIQKLEDNVYDAIFLDPFSQNMAPELVSVDFFREFRRVIKDNGIVCTYTSSAPVRMAFIEADFYVSLGPIFGRFQGGTLASPSPKNLTKSLPKNDEIKMALSDVGIPFRDPNLNLSSKEILDNRTEERHNARHNTKISSAVKTPIFLAQEMDDEPLKRRVERNLRKMNIPGVLSEEAFYLVGPEENYSEDYAEDNNSRTRVIEMAKRLDEIKNNKVIF

SEQ ID NO: 7036 - protein, 157 aa, Methanobrevibacter ruminantium
MDVKIKEKLDNLFNYISNALSSIYSRKDEKDYHDFISSINGRLICMADILDESEEFEREYYTFLKIKKMIYYVLENIESINREDCLRVFDSFSKFNLLILLKFNYLDGGISQEEYQTKFDDFTLYLREFREYFYLNVYEKDGRFDALINEVSYIFVN

SEQ ID NO: 7037 - protein, 125 aa, Methanobrevibacter ruminantium
MDKKINLINFFWEEILFGLFKEKSEFLSCFVKCSNEVPSKFEINKDYLLNKLQLYNCGLNNFRKYCDLWHSLENLGIHEEDRKIILDAHDFAKDQFTIFVTVDEEFYNAVKSFSKLNIDKYKLLN

SEQ ID NO: 7038 - protein, 96 aa, Methanobrevibacter ruminantium
MDFIDTNIAIAYTFFPDKYFKTVDDFIVNSTEFYCSNNVCEEYKRKYKSIFTSFEYFFDEIILALENNNRIFLNKCSFEQFVLSQTSDIIWIWIKK

SEQ ID NO: 7039 - protein, 173 aa, Methanobrevibacter ruminantium
MYNINEKITLPRIEIKMDVKIKEILKNFLNNISNTLTSLNNKNDEEKSLELISSMKEYLLDFAMFLKELKEFQKEFSFFLVIRRMLNYVLDNYGSLCSSKRSVIFDSLFKFFELLRIKLSFLEGIYSKSSYLSYFNKFDTYLDEVKTEYYLNIYQRTGEFDDVIPRISQIILD

SEQ ID NO: 7040 - protein, 677 aa, Methanobrevibacter ruminantium
MGLFDNIKKIRNKESANSSSAILASTYNKINRRFGVGTDASSYIAKNMHKFYITSSKFSKGVQIKNLLRKLDITIHPEGFIYFLDEFRNLDYHGQIINSPIDYSLILDYSIYDLNEFYFNPKEGPGFRNQSSDYNREMLAILDGIELLIYEINKALAKSSRDDKSKYIRIFEDIIDKKASHFEEALQRILFLNQLLYQTGHSLNSLGRLDRILEDYYYNDLNDGYITNKEALELIKDFLKALDSYSWYKTDDESGLASQLITLGGKYIDEFGEYYFYNDLTYIFLEAIGQVNPKDVKIALRLSYKTPDDLIHLALDCLNENTIYIEEGVAVSFIIDNRIFTADGATIEANIDSNIVFSNDEAIIPRLLDFGYSSDDAYNYILSAHLEPTFISCLDEGNLSSISLLKPLNDIFEDKNELRFIINLDYLMELYKNNLKKEIEEKISALDQIQWNQDPFLSLFSAESYENQLDISQGGSRNNHFGIRFYGLQNTVNSLYNLKKIVFEDKTIDLIELDKMRKNNFKRGKYQETFLLLKNNPVRFPQNNPEIANISNEIIAFIGDSIKDYKNSLDGKLKFGLSAPRYMIKNDKRASFDATLKDIPPARLLISSQKTNSDIFIFNSSLDYKSSAINGNLIELNINTNDKQLTNILVEAIGYGFDQLQINLIREEIITKEDTEE

SEQ ID NO: 7041 - protein, 211 aa, Methanobrevibacter ruminantium
MNSDKKITKESSILDIGCGNGNFLSQLKRGGYKNLTGIDLFIEEENILEGINLIQTSLEDYKPSEKFDLIVSNHAFEHMDNQLANLKCFENLIKDDGLILLRIPIKSEPIWKRYGVNWFQIDAPRHFFLHTLKSFEILCDKTDLKILDVIFDSGYAQFVFSENYQNDIAWGEDGWTDFRSNKKLIKKYKKETNFLNSQGQGDQCMFVLKKI

SEQ ID NO: 7042 - protein, 108 aa, Methanobrevibacter ruminantium
MRILNGENMKCPICENEENNLTFIIKEMQIGLREEFEYIECSNCGCLFIKEIPKDIDKYYDTDYAPHLKPKSFNEIIFDKGSAIILSNSILSNLIPKEFVPPPFKINK

SEQ ID NO: 7043 - protein, 365 aa, Methanobrevibacter ruminantium
MKYDYLIVGSGLFGSVFAYEMNRRGKSCLVIEKRSHIGGNVYTEEKHNINVHKYGAHIFHTNNKEVWNYINQFAEFNRYTNSPVANYKGELYNLPFNMNTFYQMWGVKTPEEAKAKIKQQKAEANIDEPQNLEEQAISLIGRDIYEKLVKGYTEKQWGRDCTDLPSFIIKRLPVRFTFDNNYFNDLYQGIPMGGYTKIIEKMLDGIDVELNTDFLEDKDKWMAMADRVLFTGMIDEYYDYCFGELEYRGLDFEFETLDMENYQGNAVINYTDRETPYTRIIEHKHFENAVSDKTVITREYPKAWEKGQEAYYPMNDERNTELFNRYNDLADKEGNVIFGGRLGMYRYFDMWQVIDEALKLVKSLE

SEQ ID NO: 7044 - protein, 60 aa, Methanobrevibacter ruminantium
MEIQYLLNQALENENIREIEIVVKILKEFEKITQIKFELLHKELMEKPKKGLKQSKFSII

SEQ ID NO: 7045 - protein, 51 aa, Methanobrevibacter ruminantium
MNQNSKKEFEKRYEEFSNFFFKCEIEYHTLKGKTKHLMAKKYLSLFDMEYL

SEQ ID NO: 7046 - protein, 193 aa, Methanobrevibacter ruminantium
MYMNTPSQKNIDIKNYERIFKEKINFVVEKISRFFKGTSQEDSFLNEKLLDLSDPFIKSRIKEIKETTESIAEYLKIEYINYDEYYDFREIQSMMNQTLDYGSIEELKIILKIFNEFKNLTEFKFELLSNKSHSKSISFKDIDEESKEIFEKRYGEFSKFFFNRKREYYAIFEGECEEDVSEFFELMKKHALK

SEQ ID NO: 7047 - protein, 227 aa, Methanobrevibacter ruminantium
MKLFIDSNVIIGYCIEIDYWHYYAENLMKNENIYWSTTVKGESEYKLEKLIKTYSNFFNQIKEDLDKEIISKTEFIKLVKSIEYINNKKVPFEQENLANLVWTKGGWLDDVNSIELNENLNLISQGLKKKMYRNYNYCDEMLNLYERQFKAEYIQLVKRLEELKRGNREIHSPDSEILVDCHDLSLSQNLDMGFITSDGDIVYFKKEIKKMTNIKDIIYLKNVHRYT

SEQ ID NO: 7048 - protein, 594 aa, Methanobrevibacter ruminantium
MCGIVGCVLKEGKVAPILFDSISKLEYRGYDSIGIACADEDKINLKKDSGKIAEVDAKLDLCDLEGKYGIAHVRWATHGDPSKINSHPHLNGDGTIAVVHNGIIENYLSIKEELEGEGYQFVSDTDTEVIPHLIDKYMKTGLDLTQSVRKVIGVIEGAYALAAISSAEPNRIVATRKDSPLIVGIGDSEFFVASDYPAILKYTNNIAFLEKGEIVILDEDGVKFLDENDQEMTKEIEVIEWSPEMAEKGGYDHFMIKEINEQSTAIKNTLNEKDKVKEIVDEVKGTINRVVFVACGTSYHASLTGKYLIESLVGIPTEVLLASEFKYSAKALNDKTLVIFISQSGETADTLKALDVANETSKTLAIVNVRGSSATRRADYVIQTQAGPEIGVAATKTYVSQLVAIYLFSALLGEDHELLKRLEKVPDYIEEVLQKRDEIKEISKKYKRDKDAFFIGRGFSYPIALEGALKLKEISYIHAEGYAAGELKHGPIALIDRNIPVVVVIPPGQDHKKIMSNLQEVKARGADVLGIGAVGDEDLISESDDTFLINCDVDDIIAPLVYIVPLQLLSYHVSVIRELDPDKPKNLAKCVTVE

SEQ ID NO: 7049 - protein, 235 aa, Methanobrevibacter ruminantium
MENAPNKEDIKKIAGDDLSKAELKKRIIELYDSGQTMMDIADSVNRSKIYVSNVIHGFYDEDEIKVRQYDKLRGKAKLDFSRYRSSTGIYRVSYVENKRSGNDYWSYQYYDDGRLKRIVSVNLYKLKTVVTEKGLDWFEFTEEAKEMVLKDKENFDESSLKRTNKTGFYRVTKRKTNTKQGYTWAYSFKENNHLYFVSSISISKLKEKVLSNGWEWEELTEEATRLVEEDSKKRI

SEQ ID NO: 7050 - protein, 249 aa, Methanobrevibacter ruminantium
MIEMDSKKLLYEGKAKSVFQGENADEVIIDFRDDMTAGDGARKESMGKKGYFNSIICAKIFETLEEAGVETQLIELTEPCVMKARKLDMIPIEVIVRNIATGSIIRKFPFEDKSPFNPPLIQMDFKADEFHDPMLNDAIAIALGIASQEDLDKLRELALKVNEVMSKMFKEIGIILVDFKIEFGKDSQGNIILGDEISPDSCRLWDAETLDMLDKELFRQGKDDEVIDAYEEVFNRLLTEEDKAKWNIK

SEQ ID NO: 7051 - protein, 90 aa, Methanobrevibacter ruminantium
MMYDIEVKVSLKAGMLNPEATTIQRSLSLLGYEVKGTKTKEIISFVMEAESEDDARAKVDDMCQKLLCNPIIHNYTIKIIKMDFTCASCE

SEQ ID NO: 7052 - protein, 217 aa, Methanobrevibacter ruminantium
MAIGIIRFPGTNCDRDVYKAIDLAGGEAEYIWWNNEDLTDYDGIVIPGGFSYGDYLRAGAIASNTPVVEGVKALVKEEKPVLGICNGAQILGEIGLVPGLFITNEVPKFNCEWSRLKVANNKTPFTKNFDLGQIIDIPIAHAEGRFYTKDIDLLKDQDQIVLQFAEENPNGSMEAITGVSDESGLVVAMMPHPERATTKLLGSDDGLEFFKGMLDSI

SEQ ID NO: 7053 - protein, 237 aa, Methanobrevibacter ruminantium
MPVYLIGAGPGDPDLITLKAVKALNKADVVLYDYLANDEILKHAPDTAKRIYVGKKAGEHYKTQDEINQLIIEEAKENENVVRLKGGDPFVFGRGGEELLALAEEGIDFEVIPGVTSAIGAPTSMAFPITHRAVATSFTVVTGHEDPTKENKQVKWDYTADTLIILMGIGNIKENTAEIMKYRDPDTPACAIESGTLPNERVVFGTLATIADKEINTPAILVIGKVIDVFKQIKGIE

SEQ ID NO: 7054 - protein, 503 aa, Methanobrevibacter ruminantium
MKILFLNLPYEFNISRASRWPEKTKSGTLYYPYWLAYCVGVCEREGYDCKLVDCITKAYTTEDTVEEVKNYQPDYIMAEITTPTCAYDYTVINAIKEAYPKAKILIGGTHATILPDAVLKECLGIDYLLRQEYDYTVGELISSDDVASVKGVSYRVNSDGVDIASLGINLLTEPVDFEVRHTEDREPLEDLDSLPYVSKVYQKYLNFDDYAYAFAQKPMIQIVSSRGCPNQCNFCSYPSTMGGRIYRTRSVTDLADEFEYILKELPEIKEIFIEDDTFTVNQPRVIEFCDEIIKRGLKPIWSCNTRVDLTYETMKKMKDAGCRLLVCGYESGNQDVLNETKKGITLEQSRAFAENARKLDIKVFGCFMIGLTGDSLETIDETYKFAQSVYPDMCFFQQAVPFPGTGFYDWAKENGYLITEDYSKWLNEDRYLNCLVDYPYADHKEIEKLRDSLMSKYYFSFAYIVKTFLANLDWVEFKRVMRGGTQYITFRLKKALNKSDNLD

SEQ ID NO: 7055 - protein, 258 aa, Methanobrevibacter ruminantium
MKKKIAITRPQERSKAAKEFIENYGSEAIIVPTLELKLENTESLKNLMEKSNELDWLIFTSVSSIESIFEFYPDFLDKLNPECKIATIGTKTAELGIKKGLPIDIIPKDYTAEGLLEEFERIDLNNKNVGVPRTFSARTILPEGLKNMGANVILAESYKSVIPEDTSKIEKLIQCILDEKIDGITFTSPLTVSNLFEIAKDEDKDNLVEKLSTTTLTVAIGPITGNILNQLGVNHIYPKRYTVKDMIDLMFRELNNRE

SEQ ID NO: 7056 - protein, 301 aa, Methanobrevibacter ruminantium
MNGEYLMFIDSDDTYPKDACEILLNKIEEYGCDIAFGRYLRHYPEENFIRKSYTPYIDTLDEPYLSYLDDLVKGSNFKGIVGSLWKNIFSKFFYGSSIDMNKFNSKESDNSHPKELDKNYKNNKEIFIRNIKDENKEEIAILKILPSFWTKIYRSELISKNNINFPECVSAEDLNFLLEAYFKSENGILFLNDKIVYNYFMRLEVVDKSVTKNINFRLVYDSIKAYRLSSELCDNFNIKNKDLFLNPYLLNWISLWLSRKNTKEENKIFLEEFDKLDKTKKYGLKYKLILKTTKLLLKIKS

SEQ ID NO: 7057 - protein, 107 aa, Methanobrevibacter ruminantium
MKEVMIWPIYLDADKSLNEGRKISQEYAISEPRIKEIEKAAQKLKYKYTVEEDKSYPGEWYNKSGRIIIETDDSKKEILMNLSNSIKDIREARKNYKPTKKGKKGKK

SEQ ID NO: 7058 - protein, 480 aa, Methanobrevibacter ruminantium
MIETLPPDMKQKYEEAKELIESSEDIKIYSHTDCDGISSGAILSTILKRIGKDYEIEIVNLDVLEDLEIEHELTIFSDLGSGQPVDKHAKKDSKILILDHHPPLREMDYPDSVEYTYLEINPMFHDIDGSQEICGGGLCYLLAKEFGYRDLSWIGVLAAIGDMQNTKTGKLQGMNKTILQDAKEEGLVSSDTDLSLYGRQTRPLFVALSYFSDVKLPITNNKNETIALLQRLGIPRRIKDESVPSGERATTLSDLNDAQKRALTSELIRMISNEIPPRYSIYVPKLVIADTYEFLAEEDGTFLRDASEFSTAMNACVRNNEEVVALKILEGNRAEALDALEIISKDHRGYLAENIQSIEDEHKIIQMKNLQYFDGSGIRSNVVGTIAGMVLSYGDWRKPMIAFTQVSDENQDLKISLRCSRLLAYDGIHFGNIIREVAQSLGGNGGGHNVACGAYIPKDKKDEFLNLMNEKLEGKLALED

SEQ ID NO: 7059 - protein, 275 aa, Methanobrevibacter ruminantium
MEILQKRGALTHFQILGEISKQEPNLKQKDLAERLGITIQAVSENIKTLTELEYITSKDGRAPYKITQKGIAKVKKDAIILRKYTDSVLETMTYYKSTWPAIAKEDLKEGDEVGLYMENGRLYASINAQTSAYADVILDTKKGFDVALTNLKGTIEIKDSKILIVTLPPIKDGGSRSADLDLVKGIYEGNYENYGLSSIDKVAAIGTTSHAVANNLGIPIDIEFGVSEASQSAVRKGLNVMILSIGDMSKNISKDLEDANIQYQVIDAKKSVKTA

SEQ ID NO: 7060 - protein, 231 aa, Methanobrevibacter ruminantium
MENKLIRQDTSDLDIVNHPEIKGLQIIEGKINFPISWLNQQGYCEYTLYLQYLKGIKTMPTQAMTTGTKEHLKLEEEFKQTATPSSFDDAFKESKEKEILSREMFVIDSEEGVRGFIDEIWMTPDEIVIIDDKPGNRAYPSSMNQVRAYCLAFKNMIGDDNRIIRGALRQRGTDNIFWSEIFDEKVEENILYLIHRMHGLFEGTKPFIPTKNGNKCRACRYQSYCEHKVDI

SEQ ID NO: 7061 - protein, 146 aa, Methanobrevibacter ruminantium
MDLFVKRIIAYILDFFVVSAFMWIFSYLAYFFINYLNMFQIYHYFIFILPILILVYFTFLEKNIGATVGKKLMFIEVKSTVAKRSRNGRNYNLTYGQAFIRSLSKIYWFPIIIDVILGKIAGKTRLLDGFSKTTVVEERVDRYLYY

SEQ ID NO: 7062 - protein, 336 aa, Methanobrevibacter ruminantium
MKIGMSHGAGGEVMGNLISETILNNLSKKAVEGGLGLDALDDGATIPLGDYEIVFTTDGHTVNPLFFPGGDIGRISAAGTINDVSVMGAKPLAISNAMILQEGFPIEDLDKIIKSMSATCEEADVAVITGDTKVMEQDKLEGIVIVTTGIGIAKKGEVIKDSTLSVGDKIIISGSVGDHGMSLMSFREGFGFETELKSDVAPMWGIISKALEVGGVTAMKDPTRGGLANCINEMARKSGVGVLLQDEAIPVKQEVRAASEMLGIDPYEVANEGKVLMGVKAEKAEEILEAIKTDKYGADAAIIGEVIDDDKVLIETGIGGIRILETPIADPVPRVC

SEQ ID NO: 7063 - protein, 125 aa, Methanobrevibacter ruminantium
MAICQGKSTRTPSGARRVANRGKRKSELGRESAETKLGDKNLRKIRTRGGNVKNRLARDNKINVVDAEGKAQTVEIFGVIENTANPNYVRRNIITKGAIVETAAGKAKVTSRPGQDGVINGVLIE

SEQ ID NO: 7064 - protein, 226 aa, Methanobrevibacter ruminantium
MPESPEQLAIEKEIQIQKDKFLNFFNGELPDTMELEFEGFYRRGFFVSKKRYAVIENEKIIAKGLELVRRDWAPIAKKTQEEILMAILKEGDVKKAEKIISKVLRKIKSGDIATKDLIIHTQITKNLDDYKQIGPHVIAAREIEAHGIKVGKGTIVQYIISKGKGSISQRAVPYEYSEGVEYDKEYYIENQLIPAVSRMMEPLGYDKNRLRELASTERQQSLDAFF

SEQ ID NO: 7065 - protein, 226 aa, Methanobrevibacter ruminantium
MTKAVFFDIDDTLLDTSSFADLARHAAIESMCNNGLPLEPDEAYDLLKDIIKEKGSNYSKHFNILTKEVLGKEDPLLVAIGMTTYHNVKFALLRPFPRTSAILIYLKSNGYKLGAITNGITIKQWEKLVRLNLYHFFDIVITSEEVGVEKPDPEIYLEACRRMACDVKKSVMVGNKLDIDCMGAVNAGMSAILVNSTLDEEEKERVNNEDIDIIVLDSISDVDTVL

SEQ ID NO: 7066 - protein, 90 aa, Methanobrevibacter ruminantium
MSDFEEVMTEYIKISKHREKVFKTLKDGSKKPSDIARETNLNINSVSLSLKQLTEKELVYLLNPDDKKGRLYKLTEIGETIIKEFDEKTE

SEQ ID NO: 7067 - protein, 258 aa, Methanobrevibacter ruminantium
MTKIRLISWNVNGIRAIHKKGFLDWFNEEKADIVNLQETKAKIEQLPKKLINVPGYTSYFHSAERGGYSGVATYTSIEPNEVINGMGIEKFDIEGRLIRLDFDDFTLLNIYYPNGGRDEERLQYKLDFYDAFLDYANDLRDQGKNLVICGDLNTAHKEIDLARPKQNEDVSGFLPIEREWVSKFLDNGYVDTFRMLHENEKEKYTWWSYRTRARERNVGWRLDYFFVNEEFKDNVRASYIISEVMGSDHCPIALEIEI

SEQ ID NO: 7068 - protein, 515 aa, Methanobrevibacter ruminantium
MSEVIDKIINELHIYEKKLLKELEKNEDLSPDEIAQDTGLNIKSVMSAAGILASKGIITVKKDVEEKFSLTKYGKKYAEIGLPERRILNELQEKKELHMKDLAKIDSLEKKEINIAIGWLVRKGWAKINKGVVTITEVGESSKDKLGDDEVLLNLLNEKGSLSQDELDEDMANGLAALKDRKKLIASEKTTSHSFQLNDLAYEILDKGFDLTEEATQLTHEQLKDGSWAKLKYRPYDINAEYPIFFPGKEHPLRRIIQEIREIFLNLGFTEAKGEYLESAFWNFDSLFQPQDHAAREMQDTFYVKNPLTCDLPDDDLVERVAKTHEDGGNTNSEGWHYDWDADIARQSVLRTHTTGISTQALANWELPIKMFSVGRVFRRETFDYKHLPEFHQVEGLVAAPGINYQNLLGTLKEFYKKLGFEVRFRPAYFPYTYLSTECEIYLEEKESWIELGGCGMFRPEVLEPLGVKVPALAFGLGIERLAMIRYDLSDIRMLYKSDISWLREVPLEEGINFE

SEQ ID NO: 7069 - protein, 299 aa, Methanobrevibacter ruminantium
MEANQIAKLAQIASALEVSGYPKPGNVHRTRNYDDMVFEDFIISGVVIGDTIRELANHTQSIDDLSDANLGKYILEAVAETNKWIANNTNLGIMMMCVPIAAAASISDDFSQIQENVGKLMDATTVEDAVDLYDAINLADAGGMGDQDEFDVTSEKAKDELRANNQTMFDVLKISAPWDRLASELTSKMPVSFEIGYPTFTGFCNSCEDVDKINKATVLTFMTLLSEIPDTLISRKYGDEVAKDVSLKAKELLEFKDDDDFVEKLLEFDDYLYENKYNPGTTADLTAASIFISYLDKEF

SEQ ID NO: 7070 - protein, 331 aa, Methanobrevibacter ruminantium
MDFPNTRMRRYRKNSKIRDIVRETKLNKEDLIYPIFVKEDLKDDEKEEISTMPGEFRFSINGAVEYAKTLEAKGLRSIIIFGIPSDSEKDEIASPAYSPTGIVQKTVRKLKAETDLVVITDVCLCEYTSHGHCGILKENEDTDFGYEILNDESLKFLAKTAVSHAEAGADIVAPSDMMDGRVAAIREALDEAGYYNTMIMSYSVKFASSFYAPFREAACSSPSVGNRKSYQMDPANAREAIREAELDVTEGTDFLMVKPALPYLDIIKTVKDEFNLPLVTYNVSGEFSMIMAGIENGYLTEDSIMESLLCIKRAGADLIISNFAPYALDHL

SEQ ID NO: 7071 - protein, 366 aa, Methanobrevibacter ruminantium
MTNTIGKIFRITSFGSSHGKALGAIVDGCPANLELSEEDIQIELNKRRPGTSALTTARKEQDQVEILSGVFEGKTDGTPITGVVYNTNQKSKDYSSLKNTPRPGHGDYCWIERYGNYDYNGGGRGSGRITIGHVIGGAIAKKLLSAKGIKIISHVVQIGDIRAKEANIESLEENITKNNVRCGDLEVAKLMEDLILSKKEEGNSVGGVVETIALGVPAGLGEPVFGKIDGDLAKVLMNINAVKGVEIGLGFGVATKTAKEINDEFYYERDDVKTKTNNSGGILGGMTNGMPIVSRIAIKPTPSISQIQETIDLNKKENTTIEIKGRHDPCICPRVTAVAESATAIVLADHMIRSGFIHPTNLEKRV

SEQ ID NO: 7072 - protein, 313 aa, Methanobrevibacter ruminantium
MKITFLGSGGGRFTTISQKRMTGGFRLDNFGGKNYHIDPGPGALVRSYQFGVNPTKIDGIYISHSHTDHYGDAEILIEAMTRGMTKNNGIIMGSRSVFEKYKRWGPAISNYHRSNSKNLILVPNKIKRFPDFSIKGTDTIHGDPTGVGFQMEANNLKVSYTSDTRYFEELKKYHKGADILIGSVLRHDDDAIKGHMCTDDFINLVGDVKPKLAIMTHFGFKMIAANPVEQAIKVSKNTGVRTLAAFDGMLVDVNEKYPQKSRMLRLKDRFAAHMKQEDVYSTNFKVKSNKRNKMRNKKKYYNNNDSNNSFSSK

SEQ ID NO: 7073 - protein, 308 aa, Methanobrevibacter ruminantium
MSLIIAYVGKKGCVMAADKRRIAYFGLKEQREILEQEIYSGEIHNDEELYARAEELDVNLKVTDNACKVKSIENVAIGEVSSRGTMETKRKRIYGTSNGFKIIELSGSHVLNSKRGVSSIIVFGNKVTKSLANKMIQERWKPSFSLKYMGEIFGEILKDIAEITPSVGKDYDVIIEKNNLAKSQVQDYIDEVAERDVKVLAKFRAQLREQLMEQNENIKLASTIIEEGSVGEIVIIDDTLIEVKLNPDVRAFDVNWKVLAGPGENVLMVVDDSEGLDKGDEIVIEDEVLCVKKNKANLKCDIILCHLE

SEQ ID NO: 7074 - protein, 126 aa, Methanobrevibacter ruminantium
MVKINEIYRCNHCGNIIEGIVEGAGELVCCGEPMELLEPRQLEEGGVKHIPVVTKEDGKIVVKMGEVEHPMLEEHYINFVQLTIGDQVFRANLKPGEEPKAVFDINAEIEDIKAIEYCNIHGLWHA

SEQ ID NO: 7075 - protein, 780 aa, Methanobrevibacter ruminantium
MKEACPKCNGTGLVAVDTKICDACDGTGYEDTFEMKNHFKGVTSNARAKFDLDADQDIPCEVCNGKGVVDVFEDCPYCKGTGQINVCNSCGKAIPDDKDYCDECNEKQLEEKMNKVKERLENPKKLKVESDIEGKEIVYELDGLCDMSDLEINSLYKGKVTRVERYGVFVSLNNQVWGLMRTSNPHNKVGDTIFVRISQIKERKREVDMVPAHVFKGEYVVKKLSKNIGRTKIETLDESSLKSIVKVYGEVIQIQQTSGPTIFTITDETSITWAAAFNEPGVRMYPEIEVGDIVEVIGEVNQHNGEIQIESESISKLDSDEAEAMKELIDIALDKKAEPDDVDFLIESPVLERLKPKMREAAKVIRRAVLDGRSILVRHHNDADGICSGVAIEKAVIPYLKENNPDNDAEYHYFKRSPSKAPFYELEDVVKDLSFALEDLDRHGQKLPLIVLLDNGSTEEDIVALMQAKIYDIEIVVIDHHSPGNLITKTLRNGETVSGDVESAPEDIMGGTVAVDEYVDTHVNPYLVGGDSQITAGALATEVAHFINPEIEDLIKHLPGIAALGDHAESDEAEQYVELAASKGYSRDRLKQIAECIDFEAYFLRFMNGRGIIDTILGVDNIDKHPKMVDALYKEYLRRVDTQMKAALPNIKRVKLDNGIYFNVLDVEKYAHKFTFPAPGKTCGFVHDKIVKEIGDDKPIITLGHGPDFGVLRATDTVHQLFGFNVNNIVISLADKIPQAGIDGGGHECAGSIKYIEGLGKQVLTELLNEVSEMTDSSKN

SEQ ID NO: 7076 - protein, 124 aa, Methanobrevibacter ruminantium
MYSDKVMDHFANPRNSGEIENASGEGTVGNPTCGDLMTIYIDVDDDEVIQDIKFKTFGCGAAIATSSMITEIAKGMAVDEALKITRNDVADALDGLPPIKMHCSNLAADALAEAIKDYKEKQEE

SEQ ID NO: 7077 - protein, 402 aa, Methanobrevibacter ruminantium
MIYMDNSATSPVKEEVFNAMVPYLKEEFGNPSAFYSLGRSAKKAVETARENVAKLINAETREIIFTSGGTESDNMAIKGIAFKLEDKGKHIITTVIEHPAVLRTCEYLETKGFEVTYLPVKENGILDIEDLKEAIRDDTILISVMHANNEIGTIQPIEEVGGIAKEKGITFHVDAVQSVGKIPVDVKKANIDLLSISSHKLYGPKGVGALFIRKGVRIETLIHGGGQENNLRSGTENVPGIVGFGKAAEIAYNNLDANIEKLQEIRDLLIGEVLDKVPEAYLNGDREERLPNNASFRFAAIEGEGLILRLDAKGINGATGSACSSKNLKASYVLSALGLEDAEIHGSLRLSLGVENSIEDVEVVSDAIADVVGSLRQMSPLWDNEKNESLELDESKFTDVDH

SEQ ID NO: 7078 - protein, 439 aa, Methanobrevibacter ruminantium
MTNKNYGLSTLGLHAGQEEPDPATGARAVPIYQTSSYVFSNTDEAANRFALQEFGQIYSRLTNPTSDAFEARIAAIEGGNSAISAASGLAAISYALLNITPPGDEIVSANNLYGGTYQLFDYTFKDLARNVIFVDSQDYDAFEAAITDKTKAIYAESLGNPKLDVPDFERLAEIAHSHDIPLIIDNTAAVGLVRPLEHGADVIAASATKFVGGHGTAVGGYIVDSGKFNWGNGKFPTISEPDPSYHGINYWEIFGDFPGLGNIAYTLRIRARLLRDLGATLAPVHSFIFLQGLETLTIRMEKHSENALKVAQFLDNHPAVSWVNYPGLEHHPSHETAKKYLGDKFGALIAFGIKGGLEAGKEFIDNVELLSLLANIGDAKSLVIHPASTTHQQLTPEEQESTGVTQDLIRLSIGLEDVDDIIADIDQALAKVSEKFGDD

SEQ ID NO: 7079 - protein, 699 aa, Methanobrevibacter ruminantium
MTDLNKMFNPDSVAIVGASNSEGKVGYIIVNNMINDGFKGNIYPINPKDDEIQGLKAYKNVSDLPEVPDLVIVSIPSVLVNPVVEECGEFGVKNMVVITAGFKEIGGDGVERENQLVALGEKYGINIIGPNSLGITDSHTPLNASFSQIMPPEGNIAFISQSGAMMVAIIDWSVTSGIGFSKIISLGNKAGTTEIELIEYLSYDDETAVVICYLESITEDDDFVRTLRKVSYKKPVIILKSGSSSAGAEAASSHTGALAGSDIAFDTAFKQSGVFRVTTMDELFDVGLAFSKCPLPTGRNLAIITNAGGGGVLSVDAMERYNLDLVKFDEKTNARLKEAVPEEGSIKNPIDVLGDAPVIRYKESLEAVLDSDDVDGLVVMVCPTASADADGIADALVEGASGFDKPVIAVNMGGPIFENANDVLRDNGIPTYVFPETAVKVFDYLARFAAVQDRNYDDPVGELDDVDKEAVEEIFAKVKAEERDTLLGSEAYAVAEAYGIEAAPIKLATSAEEAGQLAEEMEFPVVLKIASDKILHKSDIGGVKVGIQSKEEAEEVFEEIMANAKKAHPDIVPNGVEVQKMMDSGIEVLVGMVRDSQFGPMIAFGMGGVLVNLLEDVSFKLAKGLTTDEIAEQMESTKVMGLLKGFRGEAPGDIEAVKSAIIRIAKLTLDFPEISELDINPIFVYEKGSSALDIKIKLA

SEQ ID NO: 7080 - protein, 480 aa, Methanobrevibacter ruminantium
MTREKGELNTLFADKIKLFVCGPTVYDDAHIGHGRTYISFDTIKRYLEFKGYSVFYLQNITDIDDKIINRAKESGIDSKYLAEKFEKRFIEDMAALNVTSVNYFARATDHIEEILDQIQRLIDKGYAYVTETGVYFEVAKFEDYGKLSNRKLEDLETHRIDIDSSKKSPHDFALWKNREAPEYAGEPVWDSPWGKGRPGWHIEDTAITEKYFGPQYDIHGGGLDLIFPHHDSEIAQMEAVSGKEPLVQYWMHTGFLNVSGEKMSKSLGNFITIRELLKEYSGDTFRLFVLLTHYRSPIDFSEVSLHQAERNVSRIKNYLENLDEKINDIFEKGNLSEDLLKLAELEENEFDEELINFDYFKSNYPALKEGVNEFFTSMDDDFSTPKAIAAIFSFIKQSNKDLEEDDLIIDDLLAIKHWFKDISQILGIDFFVYKDETSGNEAELLDIIADVRLKLRAEKKYDLSDEIRDKLISLGIEVSD

SEQ ID NO: 7081 - protein, 126 aa, Methanobrevibacter ruminantium
MKPPCEMVVWYIIPAIRSELAKDLLKLGMKQKKISELMDITQPAVSQYLTDKRGSGIGFNDDVKALIQEFANDLNDGTATKFDIIPRTCYICKRIKTEDVICQIHKEKGHMPADCQACLGSEAHLL

SEQ ID NO: 7082 - protein, 246 aa, Methanobrevibacter ruminantium
MFDDLKDDLQAAKARDPAARSSLEILCCYPGIWAILLHRWNHWLWTHNLPFWGRFFSQISRFLTGIEIHPGAQIGKRVFIDHGMGIVIGETTIVGDDVLIYQGVVLGGTSLSKGKRHPTVEDAVVIGSGAKVLGNITLGCSSKIGAGAVVLQDVPRGATAVGVPSRIIHEDRKCVLDLEHEFPDPVSSAIDLLFERQEELEKRINILSHFHDIDHVEFSHDPKVEEVFKGADEKSFYKLNNIIEDE

SEQ ID NO: 7083 - protein, 318 aa, Methanobrevibacter ruminantium
MVNIPELKRGIANDMTEAIGNTPLVRLNRLTEGLEAEVLVKVESFNPVSSIKDRIAVNLIETAEKDGLLKEDSVIIEPTSGNTGIGLSFVAAAKGYKLILTMPETMSIERRKLLAVFGAEIVLTPGSEGMGGAIAKAKELAESTPNSFMPQQFENKANSEIHRLTTGPEIWRDTDGEVDIVVSAAGTGGTVTGIAQYIKPLKAEFKAVAVEPASSQTLGKGEKGPHKIQGIGPGFVPDVLDVDLIDEVVPVKDEDAGNTLLRLAREEGIFTGISSGAATWAGLELAKRPENKGKTIVVILPDTGERYLSTEWVFGDLF

SEQ ID NO: 7084 - protein, 201 aa, Methanobrevibacter ruminantium
MTLFKYIITSSPIGEITIIWRKKPQFQIEEIIISNPNQTSSQIAKEKYEKEGELAINKKSKQLNKVLREMENYFNEKDYKFSLKYLNLDKLKPFQRAVLEAEFKTEKGTVNTYKDLAKEIGSPKAYRAVGSALAKNPFPIIIPCHRTVKGDRTIGGFSGFAGGLESKKTLLELDGLMIQGKKIVGDSPIISLDKTSQTKLV

SEQ ID NO: 7085 - protein, 215 aa, Methanobrevibacter ruminantium
MRGFKMNDEEKIREIFRRLNEVYTIRTFHDHDPYKVLIRTILSQRTRDENTDQAANALFEVYPDIYAVADAPVEHVQELIKPAGFYRVKAARILEVSRILIDQYGGEVPREMDEMLKLPGVGRKTANCVIVFAFQDAAIPVDTHVHRISNRWGIADTKDPEETEQVLMEKVPKDLWVDLNDLMVQFGQTICRPIGPQCDKCPISDLCDYDVSKLE

SEQ ID NO: 7086 - protein, 455 aa, Methanobrevibacter ruminantium
MNLKIKNFSKINGTVKAPSSKSYSHRAVILASLSEGKSKLFDVLYSEDVLSTIRACEALGARIDKKKEIILKGDKSQTVDYLEVYGTGGKLHNVSDDPSSDMIDLANSGTTLRIMTSVAALSDNEVIFTGDDSLKTRPMGALIDALETLGVKIESLNENNKAPLKIYPGYEGGQTDILGSISSQFISSILISAPLSENGVELEVYPEFVSKPYVDMTISILEKFGISVEEEEYQFHETCKKEHTDCLGVKFIVKPQKYIASDYIVEGDFSSASYLLAATAIAGGYIRVQNLFADSKQGDKLILDILEEMGANVTVFDDYVSLRSDGNLKGIDVNLSNAPDLLLTVAVLGALAEGKTTISGVKHGRLKETDRIDTTCRELEKLGCKLEEFEDGMTIYGNTISDGIVESHGDHRLAMAFSLIGLKHDVEVENGECFDVSFPNFIEAMAEIGIDLELK

SEQ ID NO: 7087 - protein, 136 aa, Methanobrevibacter ruminantium
MSLDRFIEAQKEDYDMAFREINNGRKRNHYMWYIFPQIKGLGHSSTSRYYGIDGLEEAKEYMENEYLSNNLIKISQKLLDLETDDPIEIFGSTDSKKLKSSMTLFELVSDNEVFSLVLEKYFDGNRDERTLDLANK

SEQ ID NO: 7088 - protein, 261 aa, Methanobrevibacter ruminantium
MKGIIGAIAGDIIGSTHEFHPIKTKDFSLFNKKSHFTDDTVMTLAIADWLIEDKNSRDVLIQKLKFYGQKYPNAGYGRMFMQWVLSENPLPYGSWGNGSAMRVSPVAWAGESLEEVQQLARLSSEVTHNHPEGIKGALATADAIYLARIGSSKEEIKEHIEIRYDYDLDRTVDEIRPGYKFDVSCAGCVPESIICFLEADDFEDTIRNTVSLGGDADTMAAIAGPIAAAYWEVPRNIAYKSIHRLDYRLLNVLIKFEDKFL

SEQ ID NO: 7089 - protein, 242 aa, Methanobrevibacter ruminantium
MSKRIIFILMLIALLGLSAVAAVDADPLTDNQLNPTIFYLDFNHGALNDGFKKEFDLFEYVPTFDSVDLYNDGENVSVSFYSLNPTIDVDNLNDEIIDYTFEVMEDPKANITTLKDGIRNICSEYGADDVKINVDSVIGEDEIPVIFTTEGDSMLPTIKSGDKVLVNKSHNIHVGNLVSANSSEYGPICKRVADIDGDSVYLVSDNKKVTREYYDDYYVEYKGITTWVNIDDIDGVIIDIMN

SEQ ID NO: 7090 - protein, 73 aa, Methanobrevibacter ruminantium
MVEITSKTKYMDLLNEYPLLKTDLVKKNPKFGFLVTPMGKISLWESDLSEVSERAEMTVEDTVNLFIELVNSY

SEQ ID NO: 7091 - protein, 352 aa, Methanobrevibacter ruminantium
MKHRLNLDNKDPNYILLKEIFKIMDSRKSKSILASYGFKNLNRTIFTFKIIFISMFFGIDIPFILNELKSKKELRKYFNISEVLTADQVYKIFSEINSEKLIKCLNRILNSRNMVKRIGKKTFIVDATPVDVDINFHRNKKTKEHLEKINLKWSYSSSKGYYIGFKATVVLDYDSMNPVCILVHSGAPNDAKLFEEILENLQKRRIIRKGDTLIFDKGYYTYKNYQIGISKYKIIPFIFPKEKFSRTRLDDILTYPLAVFNKTKRIMKEKRLYNSLKMELMKKIDSWEKFKPIRGKIEDFFKLLKQGLNMREIHKYTPKSVEKTVYLNVFLGALIISQGFYSKTTIQQLSEN

SEQ ID NO: 7092 - protein, 939 aa, Methanobrevibacter ruminantium
MNAFLTLIIFIIHFIWRNILTNKEIPKDYDHKSEEKWQKKWEGDEIYKFIGDGTRPRYIIDTPPPYPTGLLHMGHILNWAYMDFNARYRREKGMDVLFPQGWDCHGLPTEVKVEETHNIKKNDVTRAEFRDMCTELTSHNIELMRGQMRSVGFSQDWSREYITMTPEYRKRTQLSFLKMYDQGLIYQGIHPVNWCPRCETAIAFAEVEYSENTTFLNYVNFPPADVPEEVLANVEGNSYVRYADCPDNADASVPGVLIATTRPELMSACVAVVVHPDDERYNQLLGKYVEVPLSGQKVKIIADEEVDMEYGTGAVMICTFGDKTDVAWVNKYDLDVIEAISEQGILTAAAGRYEGMELQDAKKQTIEDLKSEGYLTKQEEVDQNVGQCWRCKTPIEILVKKQWFVGVTKLIEESKKASNEMRWVPEHMESRLLNWADAMEWDWCISRQRLFATPIPVWYCKDCGKVILPKEEQLPIDPTIDKPLEPCQCGCNEFIPEEDVLDTWMDSSISPLSVADWPNPGWEEIFPSSIRPQGHDIIRTWAFYTTLRCLALTGQKPFDDIVINGMVFGEDGYKMSKSRGNVTGPEEVIAEYGADPLRLWAANSVPGSDVAFDWKNIKHGYKFIRKFWNAFRFISMHIFDEESEKALSGDIESIKAKLNPMDTWIFAKLNKVNKIVDTAFYDYNYATAINTIEQFIWHDFCDEYIEAVKYRLYNDDISEESRIAAKYTLRTVIEDSLKLLAPIAPFFAEEVYQYFDEDKSIHSTLWPEIDPNLDSTQVEEDGDLAIELIGEVRRFKSASKIPLNADVESTTVYINEKTENLKDVFEYFADDIKGTLKIQDFKVTSGKPEVHEKVIEIEPDMSKIGPTFKKNAGQVIGFIKSTDPNEIAKQLEEDGEIAIADGVITEDFLKMKKEIVGASGKKVDILQSEKLGVIVEVVR

SEQ ID NO: 7093 - protein, 551 aa, Methanobrevibacter ruminantium
MPVITFKYQDLKDLGIDMEKDELINTLPMMASDIEDYDDEEIKVEFFPNRPDNLSVEGVARSFKGFLGLETGIPKYEIVPSGEKVTVSPEVAEIRPFIKFAKIENVDFSGDKIKYIMDFQENLHWVIGRDRKKVAIGVHNADVISGPYKYIATPKDENAFVALEMEEEMTPGEILTQHKKGEKYAHLIDKFDKYPLILDKDNQVLSMPPIINGELTKLTEDTKNIIVDVTGTDEIAVTQALDILCASFAEVGGQVKSMEVEYEDRTVISPDFTPKVKTVHVDLTNELIGGTDLSPEDIKKLLEKARFDANILNENELEVFIPPYRVDILHEVDIVENITIQYHINAVEAKLPDITTVANEHNWFKSEKTIRELMVGLGFQEIMSLMLTSEESQYEKMNAEEIDHVQVSKPITISGTMIRTSLLNSLMEFLEDNKHQDLPQKIFEIGDVLYMDESKENKTKSAKKLAGMICHSSANFTEIKSTVSSVLSNLGYTMEISNSTNGSFIPGRAADVIGESKSGKVVGFFGEISPEVIRNFELEYPVTAFEIEFKL

SEQ ID NO: 7094 - protein, 232 aa, Methanobrevibacter ruminantium
MAQVFNYHCRSCDFYFTIHNYRFCFDDKMDCIEEYMALFTDSDYGNDSLIKGRVIEKYCSSCQKTVRIYQFTPDSSIYTTDASFDFLKFYIPKKHDFLLESIDFHKELIELIENNENLKKISSFIEDNHVYNIYELNLNHYLNTKRSGFNSNQLIKDIGLYLDAINDNLDRFDDFIICMNSTEDNYNLDLEGKMFDMDVCPECGEEFYPISLKNPCPICGKNTMERSREMID

SEQ ID NO: 7095 - protein, 142 aa, Methanobrevibacter ruminantium
MIINKSLKINSNSNFQIIDITNEISRILDEIKFNEPNSISNGILTIFTKHSTSAIVVNENERGLLSDFEFILDELVADKNNYAHDRIDNNASSHLKSFLLGSSETIPIVDGKIDLGTWQSIFFVELDGPRRNRTIDLVFIGE

SEQ ID NO: 7096 - protein, 40 aa, Methanobrevibacter ruminantium
MITCNVCGHLNPPSALVCENCGSDLSDSPDLGGGFDDDDR

SEQ ID NO: 7097 - protein, 172 aa, Methanobrevibacter ruminantium
MSENQEDETRKTNNYEFDNSGFKAKDYDDAEEFEIWDLEQIFKDRVKILQDLNNEFWEAYEGSKTEASGRRKDKKERLEPLSVRVKPHTKRFLKEDSILSAREILEIYEEFYNGRDDYIKSLKRDEIQLKEELSEIEEKLKNAQEFTEKLNEIKIQKDQEKERAKKIKINIE

SEQ ID NO: 7098 - protein, 47 aa, Methanobrevibacter ruminantium
MYRYENDRLASHEIDPTTPSKYVYWNAKRLLEVLKEVEATKKQNQDK

SEQ ID NO: 7099 - protein, 210 aa, Methanobrevibacter ruminantium
MSDKVKAEEVKSEETQVKDVDLVFLLDKSGSMYGVVRDTIGGFNSFIEREREKNPNTHVTLVLFDTEYNVLYTRKPIAEVEELTKNEYYADGCTALLDAIGTTINRLDRQVNNDVLFVITTDGLENSSREFSKSDIKNMIANHNWEFLFIGADIDSYGEALTLGIDESHAANYEKTSAGLGALFDSVGDAHEEISRGGSLDDMSWKRRLG

SEQ ID NO: 7100 - protein, 537 aa, Methanobrevibacter ruminantium
MTLDYQLSEIKELENQEELISIIQNPNLDDLRRSAAASNYNLNNKDFLKELASNINLNYKIRRGAIKNLNLDDQSLFIDIGLNDENIQIRRAAIKRITDQDTLTIIARESLDFASRLIAVEKISDIAVRLDIAVKDSNDLVSFKAVDLYPFLSTLNSLFYNFNCSGRYVDNALKLIDFIDLCLSKDFNKESHDALNKFKDYLNDLINIKLSDLKEVPYHLEKSFSRRVLTNMAILTWDLAFAIIDYTEDDYELLKIFNVQNDIRIRLAALKKIKSEHFLIDIVSNFRTGHSLYDDTLGSLQRRFSYDLDECLSIHKFTQEELIDLAVYSGFKKTRRIVVKYIGDMELLEYWALNDSYTGFRREIVSLPNFNNKELLSKLVFEDDCDRVRLYAVRKINDQEILSKLAVDDSYWAVREEAVSKIRDESILIDRALNDPNVMIIIAALKNPNLNDRQTINKIGSYPNFWVTKIIAEHPLTDDETLIDIALNNPWNYPREKAIERIYDKDVLKYIAENDKDPWISLISESRLRKLDENENV

SEQ ID NO: 7101 - protein, 101 aa, Methanobrevibacter ruminantium
MTNQVIEDMAEVCHDEWVKWSKNISEELALAIDVLKKDIEFAHEKGVENKEAIELVEKFESRLERWGALWIPYEDLTEEMKDSDRKYAIKMFDIAEEALKE

SEQ ID NO: 7102 - protein, 79 aa, Methanobrevibacter ruminantium
MIVEKVSKNDQWEDYFIKSKSSNKEYIITIDLLEGTVSCDCEDFKYRKENLRFGGVRLSDKANHCKHIKKILEIRDDLD

SEQ ID NO: 7103 - protein, 71 aa, Methanobrevibacter ruminantium
MFEKQGFIERRIFKNKESFMYKGFFSHKEDFINKGDFIEKEKSLKKQNFIKGKYANLIFKMDDDCIILKGG

SEQ ID NO: 7104 - protein, 343 aa, Methanobrevibacter ruminantium
MKTTLDNKSVKNNSRNSKNVRSNLRDNRSMRTNLRASRNMKTGLGDVNIQSNDEATKKCPSCGSVDFEIDYARSEVSCKSCGLVLEENIIDFSPSGTAINRDGQNLTQNGAPCSITKHDKGLATDFKLENLKHDRARWARIRRLQKQSRVSGSRERNLARAFSELSLLISNLSLPRDVNKEAASIYRRALEKDLVRGRSISLLISASLYAACRVCRVPRTFDEIAEVSTGSKKSIAKNYRFLNRELALKIRPASPVDYIPRFASMLELSSPVVVKSIEIINELNEKGLIAGKTPAGVAAAALYYSSRVLGERRTQKEIASVVGVTEVTIRTRYKEMTKGLNLN

SEQ ID NO: 7105 - protein, 175 aa, Methanobrevibacter ruminantium
MTILDGILEDNKKFVESFEGEEMSHHAQKKLAILTCMDCRLIDFFEPALGLERGDAKIVRNAGNSIVGEDAIRSIGAALYNLGAEEVLVVGHTECGMAGADAEALKEKMLARGIKEEDIAKYDIAEWIGGFDDEEENVLNVVEKIKNHPLIPEVPVHGLIIDIVTGELKVLKEDY

SEQ ID NO: 7106 - protein, 278 aa, Methanobrevibacter ruminantium
MANNGHGHHGAANLTPEQQKKMIEQEMKLFEHMKNIKYKIAVMSGKGGVGKSTVAANLAEAFQKKGLLTGILDADIHGPNIPKMLDVEGEDVIISNGEMIPVMSRNGIKVMSMGFLIDSQDTPIIWRGPQKSGSIKQFMADTAWGDLDVLIIDNPPGTGDEPLTVLQSLPEVDAVIMVTTPNSLSHEDVLKCVGMVKMLHIDKIGLIENMSYYVCPHCGEKTNIFGESQGEDFANEMGVKYLGNLPLTEQVPESANKDSTMVNAYAESEVATKFFRND

SEQ ID NO: 7107 - protein, 998 aa, Methanobrevibacter ruminantium
MLLVLMALLILAMSCVSASNASDNLDDLTISDSNSLDLVSTSNSDILSSDSGVSSDDSSNDASGDVLGSDVSSNESNNQSQSTLDSNNQSQSGLDSDNSTLLDSQSNNQSNSESSDSSDSSETVIKNATSISVSSKTVVRGNSLNITLKDNASTLLSNKTVTFTFNGKTYNKTTNAKGIASLTLTATPKKYLVKIAFVGDELYEASSKSVNVTLSKTPTSISNSGKSIVRGKLYKLTLKDAKGKALSGKKISISFNGKKYTKTTNSNGQVNLTINVNVGKTYKMTYKFAGDSNYLSSSGSVSIKVKMGTSIIGSGSSIVKGKSYTVTLKNANGAVLSNQKIAFTLSGKTYNRTTNAKGQASLKIGLSSGKTYNLTYKYAGNSYYGGSSGKVSLFVKTPTTMKNSGKTIVSGETYKVTLKDADGKSLANKKVSITFNNKTYAKTTNSNGQASLTIKGTFGRSYPLSYKFAGDSKYGPSSGSLCLRVKKATSLKGSASSIVQGKSYTVTLKDSNSTPLANQTIVFTLDTKKYNRTTNAKGQASLKIGLAAGKTYNLAYKYSGTSYYNGSSGSVKLKVKFPTSLTNSGKSVMNGTGYNIVLKDSKSNLVSNKTISIGFNGKTYDEITDANGTVTLLIDANVPKTYKMTYKFAGDSDYGASSGTVNLTVKFKNAFTISQIISASSSLKSYVLKNKKVPATVSVNGVSLNLTSFTYLMAKATISINSNKTSGSILLVPVDSNYTNNGSRINANLYKANYIDLAKKVISSAEANKLVPNSVSTNIGLVSHDLYSFGLAKALVFFNSDHYLPNYLILSSDDVGEKHSTVIPSNARGNASQFKAGLNEAETLTAAQIAKYLVASGHDATNSEIKALAAKLVSGKTSLWDKANAIFTFARDNITYSYYADSKKGAAGTLSSKSGNCCDHSNLIVSLCRAANITARFSHAQGCTFSSGLVAGHVWAQIYIDGVWYTADATSRRNSLGNIVNWNTNHYNTLKQYDHLSF

SEQ ID NO: 7108 - protein, 825 aa, Methanobrevibacter ruminantium
MINRLRKDFGRIIKLIIFLILEVILFFAITQTFGGIIIPDLKTAFAIIIALSILNALLWPTITYLSLRFIVLTLGFGTFLIDGVLLYIISLFIPGVSINGIALFSIPLLIGLISSMLSIILNIDDDYTYYRYILEKEMKVIHRNIPKKEGFLFLEIDGLSYRIIKEALDNGDMPTLKSWIDKGSHRLISWETDLSSQTSSSQAGILHGNNNNIPAFRWVEKDHENRIISSNGRTDSKLIEKRISNGKGLLSLNGASRSNLFSGDAKDHLLTFSRFSDSESINSNSWFYLYSTPYVIARILVLFIFDMIMELLSRVRHLFKNIQPRLKWRGLKYFVARAGTNVVLREATTFTLIGDVFAGEHNVIYATYMGYDEIAHHSGIEDFDSFYSLRQIDKQFKHIENAINNSNRDYKIIVLSDHGQSNGPSFKQKFDISLNDLLSEFLPENITVHSILHSNDDHFSKEFSINHLGSENLEKLDKRVENTKEKLDIKIDNTKEKLDHRIDNTKEKLDHRIDNTKEKLDHRIDNTKEKIDTTKEKLDHRIDNTKEKIDTTKEKLDHRIDNTKERIDSNLDYTKEKINTSFDGELINTWDKLIKFKNKSSNKAFLDKLRKKRTLINNDEPIIDRINNVSEDLSEDLEVNIELSKEKITSDKAAQTIVLSSGNLGLIYFTDWSNRMSYEQIEDAFPGLINQLASHDGIGFVMVKSDIYGTLVFSNDNLFYLESEEYVGENFLDKFGKNTVQKLKRTDKFAHVPDILVNSEYNMETNEVYAFEELIGSHGGIGGTQQYPFILCPSNWESEEIFGAENVYKFFMKEINKSWNQSKNK

SEQ ID NO: 7109 - protein, 162 aa, Methanobrevibacter ruminantium
METKKMFLVILLFAFIVIGGSYSVFAIVSNGGGNNSLSWDNITIAGPSGNVSDDGNNSDDGLLGIFNSGDSSDSSSSNSNTGSSSSQSSSSPARSSSSSSSSSSQSSSSQSSSSQSSSSSSSSSSSSSQSSSGSSYDSGSGGSVVESGGHYYDVNSGDELDW

SEQ ID NO: 7110 - protein, 168 aa, Methanobrevibacter ruminantium
METENLIIVILLVLIAMAGIFCAFLYTFGTGGNDLAPVEPNLTANQTNVTNMTNDTANATTVDAPLNNGAYGSSSIDSSSSNGLSGSNSYNGGSNTYNGGSNTNNGGSNTNNGGSSSSDSGNGGSVAPDSGNGGSSDSGNGGSVAPDSGGGGSSSGGSEPAASGESSN

SEQ ID NO: 7111 - protein, 498 aa, Methanobrevibacter ruminantium; identical to SEQ ID NO: 5951

SEQ ID NO: 7112 - protein, 203 aa, Methanobrevibacter ruminantium
MKVLLINGSPHKEGCTFTALSEIKNQLEKEDIDSEIFWIGTKPVRGCIACKKCGHKEGKCAFDDDPANEIIDKLIEADGVIVGSPVYYAGPNGALCAVLDRVFYASGGRFAFKPAASVVSGRRGGASASFDRLNKYFTISNMPIISSQYWNMVHGNTPEEVRQDLEGLQTMRTLAKNMAWMLKSIENSDLPNLEDKIATNFVR

SEQ ID NO: 7113 - protein, 264 aa, Methanobrevibacter ruminantium
MKERLDKYLVNNNLIASRTKSKEMIKSKNVKVNDKIITKASYTVRDGDKVEIINDESLRYVSRGGLKLEGAIDSFNLNFNEKSIMDIGSSTGGFTDCGLQHGAKRVVAIDVGTDIMTTSLRDDDRVDLYEQMNFKNAPSSLFKDIDIIVSDVSFISLKHIIDRIAQEDDDFELVFLIKPQFECGKEIADQFKGIITDKEVHKDVILEIKEYFKTKGYYLIDLDVSKIKGKSGNIEYLGHFKANEKVREIDIEEVIDRAFIDEEN

SEQ ID NO: 7114 - protein, 130 aa, Methanobrevibacter ruminantium
MELDSEQVVKRIEELRKDYSCSQATLMGICEVGGMPTEELALLAKGFSGGIGGTFSEGTCGAVTGAVMALGFLGADEKQIISASKKLFNEFKDKYESVTCGYISKDGDDKSPCVEVCLFAGEKVCEYLKE

SEQ ID NO: 7115 - protein, 273 aa, Methanobrevibacter ruminantium
MSCYKYWGKIEEIANKLSSYGDLDNEGLSALDGTDIDEITKILDEIEVIAHDKEIDFDSAKHILDDEKMNKALQLIRKFYVYIGARLERENALTILEADDPKVALDSFHFYDRYIGLIDNERQLANFNENKTFVFLGSGPLPLTIIMFNMVTGCKCIGIEQDPDVADLSRKVLKRLDLDEGIEIVTGNEKTIAELDYDILMIAAFAEPKDRVFANVWDIVDEDTPVLYRTYTGMRAILYSPVTEKDTRGFHKEVMLLPRGKTNNTSVLIRKIS

SEQ ID NO: 7116 - protein, 203 aa, Methanobrevibacter ruminantium
MELTGKNISFKYSSGSRQILKDVNITVDNKKILGLFGDSGSGKSSLCKILAGHIKRYEGEVRLDGQEIPKGFDPIQLIYQHPEKVMNPKWKMHDVLGESWEVPDDLLEDFGIQKSWLNRWPAELSGGELQRFSVLRALNPNTKFLIADEMTTMLDAITQVQIFESVLKIVKERNMGLLVVSHDRDLMDIICDEVIYLDDINNI

SEQ ID NO: 7117 - protein, 354 aa, Methanobrevibacter ruminantium
MSDLINVSNISISFTQYVKGLNQRELKVITDLTLDIKEGEIVAVLGSSGSGKSLLAHAILGILPHNANLSGTMVYKGEVLTEELKEKLRGDEIALIPQSVNFLDPLMKVSDQVIGECKDEAEEKEKRAKQRAIFEKYNLSEEVDDMYPFQLSGGMARRVLVSTALLTNPKLVIADEPTPGLDEESVEETLNHLRQMAADNVGVLLITHDIDAALKVANRIAIFYSGYVIEIANAEDFSGEGENLLHPYTKSLFKALPLNGFELTKGHQPLHGEIPVGCPYYDRCPHKMDDCDKTRPHLIPIDENKRVRCFKYEGEIKDSSEEQVVDSSEEQVVDSSEEQVMDSSEDQIKDGSEE

SEQ ID NO: 7118 - protein, 330 aa, Methanobrevibacter ruminantium
MLDKQKILKFLGYKLVRFAILLIVVILLSFILIDMSPINPVNAYISNMVVSPEKIAKLEAYWGVNQPITEKLINWLGNIITGDFGTSLIYRTPVLQVIAEKFTASLILMLTSWVISGILGFALGVLAGFKRDTWIDRVVKVYCYVLQSAPTFWIALLVVMVFSIYLGWFPVSGGVPIGALSQDVSFFDWLKHLILPAFTLSILGVASIALYTRDKLIEVMTTDYFLFAKARGESGWTLIKRHGIRNILLPAITLQFLSFSELFGGTVLVEQVFMYPGIGQAAVSAGLRSDVPLLLGIVIFSAIFVYCGNLIADILYNFVDPRIREGEENG

SEQ ID NO: 7119 - protein, 318 aa, Methanobrevibacter ruminantium
MITTVVGSFGIDLKEPKTLGEKIKSSIGMYDPYKIAIEEAVKLQLDCGIDIIGDGQPRGDMVGSFVKHIPGFSYEMNSSVIVSKIRAPQVDIMIKDLKYAKKVLEAEIKARNMSGDEANRKGVKLMLTGPSTIVHSSRLESFYKERNPAIIDCAYALRREVESAEKAGASYVQIDDPFLSTGMVDLKVAKESIGILTDGIEMPMAMHVCGNLDGCFKEIAKFPIDILDCEFAGNNVNIGILEENASLLSGKKLGFGCVDSAMNAVDDKEEVRALVQRGIDAVGKENMLLDPDCGLRKVDIPIAMEKLKILSDLAREFN

SEQ ID NO: 7120 - protein, 102 aa, Methanobrevibacter ruminantium
MSFCLETYLQQNDDYKILIQRSGVKQCYKLIEDNAKEIIHVNPGDKVLGARLIGLPPIPVGINEEEGTILITYTKPCHGTAAIEIPISQEEIQNVRDMDIGA

SEQ ID NO: 7121 - protein, 153 aa, Methanobrevibacter ruminantium
MKALVLLGCPEAPSQTPIGLYASYKLGQMGYDVTVSSNPAAGKILDISDPEGVYVKKRVDIEKCLDEIEEGDYDLLVGCVHKDAAATFFITYYHILKCKALALVFSRDAEEVAEFADMVESSTDADIIAVRAFHNPNPIKVRFDKYLKTLEEE

SEQ ID NO: 7122 - protein, 169 aa, Methanobrevibacter ruminantium
MGLISDTHISEKRGKLSNQILESFKGVDLILHAGDISSQTVLDKLNSIAPTIAVEGNNDRARKTLDLNPSEIIEIDGIRILLIHGDKLPSRDFDKYCKFALKENADILISGHSHRPHLERQEDILMINPGSPNRPIKSDASIAILTIDEEKEHKNKLDKVKVEFIKIEK

SEQ ID NO: 7123 - protein, 38 aa, Methanobrevibacter ruminantium
MLICPICGYPLDSDGRCWNCGYWVETHPLDPFQPGSGY

SEQ ID NO: 7124 - protein, 42 aa, Methanobrevibacter ruminantium
MLDCPVCGSELDEKGQCWVCGYNMAPCDHPDDYDYDDFEPQL

SEQ ID NO: 7125 - protein, 167 aa, Methanobrevibacter ruminantium
MTFKKEKFIKLLMFIISRSSDNYNVGKTVLSNMLYFIDFNYFETYGESLTNEIYIKSYLGAVPSHFDEIVRELIYYNKIYRRREPYYYHHINKYYLTSLHNIDLDYKELIVVGGVLDNLMGFSAVEIVDYISGDAPFKIAGFDEPLDYSFVFYRDFDYSVRNLDYYW

SEQ ID NO: 7126 - protein, 200 aa, Methanobrevibacter ruminantium
MNGGNNLDNNCKNLGNILNPTEVNNQLLFHKFIMINEILDKRNKKQNPEMKSITKGQGRLIVLLKRKDKLSTKELSEILNVSVSSLNETLNKLEQKNFIKKVPSEKDKRILLVELTEEGRQLEFKNHEDIDIFDFLSKEEKENLNDYLNQLTLSLHEKFKREDPEKYAKIVKNRKEIFDKYFKDENNNETCFEFIDCSKK

SEQ ID NO: 7127 - protein, 245 aa, Methanobrevibacter ruminantium
MANAIITGGSRGIGKAMALKLGELGYNVVINYRSDSSKQLTEDVIAEIKDKYGVEAIAVQADVSKFEDCKKLVEAAVDAFGEEIDALVNNAGITNNSNFIDLEPERYEAVINTNLVSMMHMCHLCLPYMVDRDTAIVCTASVGGLTGVINQADYCAAKTGVIGLCRALALEFAPRKVRVNSIAPGMIMTDMLRGVNQDELNALAATIPLGHIGEVEEIAGALEYILTAPYLTGQVISPNGGFVLQ

SEQ ID NO: 7128 - protein, 343 aa, Methanobrevibacter ruminantium
MKIWIDISNAPHVRFFKDVIKYFEDEGDDVLVTARKFGDIHKLMDMYDIDFISVGKHGVTLEEKLKESAERVVNLADLISGEGFDVALSKHSIELPRVAFGLGIPSLFVLDNEHAMAANKLTLPLCSKIIVPNIIDMWKLMEYGANPNDIIRYNGTSELMHFNNFVFNENIFEDLGLDLPLQRTILMRPEPSLASYLNTDCRKSVLSPVVDVLKEYANILILPRFKEQAEIFEGIKNVTILKPPVDTSSIIKACDLVIGAGGTMNREAAILQTPVISCYPGDTLSVDQFYVNNGLMYRTTDLEDITKQALSFIVNPHKPIDFKTDDLFDLIVKNTYELGGSKK

SEQ ID NO: 7129 - protein, 253 aa, Methanobrevibacter ruminantium
MHKVADVEVAKNIMDANAKLAHKNLHLLEDHDIFCVDFVGAIGSGKTALIEEIIENVDEKIGVIAGDVISKFDAGRIESHNVPVVGLNTGKECHLDAHLVGHGLGDLPLDDIDYLFIENVGNLICPVDFELGSHMRVVVVSVTEGDDTVEKHPLIFQNSDLVIINKIDLAEAVGASVDKMVCDAKRLNPDVKVITSSLKEGKGLDEVIAAIEDCKAHVAEHHHHHDHEHEHDHSHDHEHSHGHDHSHSHEHSH

SEQ ID NO: 7130 - protein, 124 aa, Methanobrevibacter ruminantium
MHELAMAQGILNAVLETAEANNAIEVTEIVIEIGKLAMLNPEQLKFMLGVLCSETIAENAELIVEDIDVEIKCHNCDFEGVANVDDSDHYAPMILCPKCESHRVEVKNGKDVTVRNISIEKEDE

SEQ ID NO: 7131 - protein, 306 aa, Methanobrevibacter ruminantium
MIIGGSASQKLAANVAKELGDVLCPIETKKFPDGERYIRIKSEVDKEVTIIQSTGFPQDENLVELLFLIRTVKDLGAEHVKVVVPYLGYGRQELRFKDGEAISAQLVANLIEESGADEFISINLHEDSVRDFFNIPTANLSAMPPIAEYIANTVENPIIIAPDKGALGFAEEIAEILGCNCTYMSKVRLGPDKVETTIVDIHSDFDSEDLAKVKKDSKVNIDSVKDKEAIIIDDIIATGGTIVNAIGILKEHGAKSVDVYCVHPVLVNDAVLKISAAGARELASTDTLKSDVSSISVAKIIADVLR

SEQ ID NO: 7132 - protein, 367 aa, Methanobrevibacter ruminantium
MLLIAQNHFQLILEVGLILLATMIFVINLVPLSLSVVTFLSLFLSGGFTILFGADLAFLVLSFGQHEFTHPFGPIALLAIVTALASLKVMEGSGVDISRLKNIVYVFLIAITVFGGAMHRSFLLLWFIGLFIGYTIISKSFRQKSILTIRRILMFFLAALVAFGLLELVSRILSMEVFSPLLRISRLAQNSLASLKLVIGNTQLIGHDPASSYWSDSTGFADGYISLPMQFILMFGLPFPLFFGLLVTKKDTIDYMLPGIFGYAYDFGYLTFVILLLLVLFTIIIGLLVLREYRLKREKNNKKYLGKEVLLIGSLTGFIAQAIIGLFLFNRTINGMALLTFLFLGSLVLAHVVTIRRDSNEVLSQQI

SEQ ID NO: 7133 - protein, 159 aa, Methanobrevibacter ruminantium
MVNIKTVALAVIAIIVVLLAIFAVSNVVILAQDDTEGGIPGVDMAALWSLNGGFQWIYPGSSFDPEGRTLHNIYMLDDPYGEVKTIMQYTYNVDPHILVIINDQAAAHIFGDNILDTIRQHDWVEGHSRGDAVGMSITSVNPLPIIPDILMGNIKIMFI

SEQ ID NO: 7134 - protein, 546 aa, Methanobrevibacter ruminantium
MTKCLMIQGTASNAGKSLIVAALCRIYTKRGYKVAPFKSQNMSLNSYTTKENKEIAIAQVLQAKAANIEPTVDMNPILLKPKGESCSQVIIQGEAVGNKDFFRKYDKTKATQRDIDNNLMDDEDYRIIAKEAVIDSLNNLKEDYDIIIMEGAGSPAEINLREGDLANMGAAEIADANVLLVGDIDKGGVFASIAGTFLLLDDADRSRFKGVIINKFRGKQELLCSGIERLEEIIQVPVLGIVPYAENLQLPEEDSASLKEHNWTKEFKNNDDHIIIGVVKLPKIANFTDIDPFDTEDDVEVRMIEVHNYKDKIKDIDALILPGTRNSTEDIMELEKTGLAQEIRKLSNESKIPIIGICGGYQILGNKIYDKNHKESKLDEVEGLGLLDIESEFIRESKVVKQSIGRIEINDNITGLNNSDENNIFYEIFSKINGETVSGYELHEGTTNLISAKPLFKIEKGIGNNDNDQFDGAYSKNVFGTYFHGIFNNYNLRREFLNHLRKNKGLDEKTGEDPYETSVENSLEKLANIVEEALDMDYIDKLVFDE

SEQ ID NO: 7135 - protein, 386 aa, Methanobrevibacter ruminantium
MRDVAIIGASQTKFGELWDVSFRELISQAGLGAIEDANLSGADLEAMFVGNMSAGLFVGQEHIASLISDSMGMNPVPCTRVEAACASGGLALRQGIMAVASGYHDVVVAAGVEKMTDVVDATPAIATASDQEWEAQQGATFPSLYAMIAQRHMYEYGTTREQLAMMSVVNHKNASNNPNAQFPFEVTVDKVLNSSPVADPLTLLDCSPVSDGAAAIVICAAEKAKEYTDTPIYVRASAQSSGTIALHSRKDITTLDATIAASRKAYDMAGVTVKDIDATEVHDCFSINGLLAIEDLGFAKKGEGGKVLEEGQTNIDGDCPINPSGGLKARGHPLGATGIAQAAEIVWQLRGEAGKRQVDGAEIGMTHNVGGTGGTCAVHIFGRDLN

SEQ ID NO: 7136 - protein, 346 aa, Methanobrevibacter ruminantium
MAGIVGYGANVPSYRIKVEEIAKVWGDNPESISNGLIVNEKSVPSSDEDTATIAVSSARYALRRAQIDPQDIGAVYVGSESHPYAVKPTATIVAEAIGATPDMTAADLEFACKAGTAGIQAVMGLVDSGMIKYGLAIGADTSQGAPGDALEYTASAGGAAYIIGNKDTIADFGTTYSFTTDTPDFYRREGQPYPSHGGRFTGDPAYFKHVLGAAKGLLEKTDSKVEDYDYAIFHQPNGKFYLRAAKKLGFTPEQYKDGLLTPNVGNTYSGAVPLALSNVLDKAEPGDKIFIVSYGSGAGSDGFTLTVNDRIDEVRNLAPTTEEILSKKIYVDYAVYAKFKGKLRMA

SEQ ID NO: 7137 - protein, 222 aa, Methanobrevibacter ruminantium
MSDEKMERVEDNELLINARKPEGELGDQLLDRMNKSHESLAQWGVSHLDISKDDIILDIGCGGGVNVERFLKMTENKVYGLDYSEVAVEKSKKLNQKAIEEGRCEVIQGSVSELPFDDEIFDIVTGFETVYFWPDFVNDLKEVRRVLKEDGIIFICNEAIPRDGDARQEELKELLDMNIYSDDELDQSLRQAGFSDLIIFDKSSSKVESKDVSGWICAIAKK

SEQ ID NO: 7138 - protein, 155 aa, Methanobrevibacter ruminantium
MTFGNDKENIFVKNVVDYGDLSKSDRSSNLGRFFPNRQSPKSDFDSVPSSIDEKIINILTFKDEGDSNGSNNDGTSDDSVDGVDYSLFDEELEYICSLGFNPFEEGGINRDSLEEHFNPYLENHPEELAFLSVFEDFTLVQMNFSDMIKEVYFEE

SEQ ID NO: 7139 - protein, 536 aa, Methanobrevibacter ruminantium
MAQGQPIFILPEGTNRLLGRDAQRTNILAGKVLAETVRTTLGPKGMDKMLVDGLGDIVVTNDGVTILKEMDIEHPAAKMLVEVAKTQEDEVGDGTTTAVIIAGELLKKSETLLDMDIHPTIIAMGYRQAAEKAQEILDDIAIEDISREMLVKVAMTAMTGKGTEKAREPLANLIVDAVQQVADDGVVETDHIKIEKKDGAVVEESTLIQGVIVDKEKVHPGMPSELKDAKVVLINSPLEVKETEVDAEIRITDPAQMQAFIEQEEQMVRDMVNKVADSGATVLFAQKGIDDLAQHYLAKAGIMAVRRVKKSDIEKLAKATGATVVSNLDDLTEADLGSAGSVIQKKISGDDMIFVEECQEPKAVTLLVRGSTKHIVAEIDRAVDDAIGVVAATVEDGQVVAGGGAPEIAMAKKLKEYAQSISGREQLAVTAFAESLEIVPKTLAENAGLDSIDSLVDLRAAHEKSPYMGLNVFTGDVTDMKEEGVVEPKRVKKQAIQSASEAAEMILRIDDVIASSGTSAGDMPMDPGMGGMPPMM

SEQ ID NO: 7140 - protein, 338 aa, Methanobrevibacter ruminantium
MVERANINPAMMLWARKRAGYINGFEEDLPKDIKSKYKSWESGEEKPTWTQLRKASKKFCLPSAFFFLEKVPEDDDFPKMINYRKLDADDIFENNSPSLIKQIRKSQSRREHYLDLLYELEENIPSFEIYEGSLNKKHVSNYIREKLGISLETQKTWIRKNKSKDSRHYNFLNKWKEIITRKIGVLIFESEGVALNEMRGLCIFHKEVPIILLNGKDSVNGRIFSLFHELTHLLLGQSAICGDDENIDEEIFYNAVAGEFLVPNEDLCKNTNADNMDTISNGAGGNYLNNQIKYNGEPYCAVVLEAYEKGIINGGEFSRFTNLNKKFIPFMFNRYLFS

SEQ ID NO: 7141 - protein, 91 aa, Methanobrevibacter ruminantium
MEEFRQQLVDKVVFSLVNTKQISNDDLDKRNNSISLDVRKLIIGRVLDKVNSNINYEGENLSYAQIIDKQAKKIVNYLINGEKYTGFSLRW

SEQ ID NO: 7142 - protein, 231 aa, Methanobrevibacter ruminantium
MKILIEGYNKSIHKRDNQILIMEKEGELEKINIKKIDDITIIGKGSITFDALRLISENNVRLMSIDYFGKINYTLEYPSNENIFLRKQQYKTSENHKGLIIAREMIMSKMINQKSTIKTLNKNKKLENVKIFERNINEAIKQIGSLRFGERTDIEKSKMKMMGIEGSASVDYWLAVNELLPKEIGFFSRNNRHPNDITNASLNYAYAILASEVNKALVINGLDSYCGFPAF

SEQ ID NO: 7143 - protein, 91 aa, Methanobrevibacter ruminantium
MKVLVSFEIKFKTNKEKIISILKHFGFRRMQENLYFGDVEYDELYAMQSDIMENIREYDSILTIPICKSCYLKLNVFGRNLSFKDELYKIF

SEQ ID NO: 7144 - protein, 54 aa, Methanobrevibacter ruminantium
MEIDDYFDIFGPSGHASMMYPGDLAGGAENVANCRCWVRYTNERPSNLKPYGTI

SEQ ID NO: 7145 - protein, 269 aa, Methanobrevibacter ruminantium
MNQLKEEVDSRMKSIEDNASEKTKQKLQKKQKKIDDISEADIDEQIETLEKENKKLKRYQRILDALQEKMEIDSGRVMGLTDGIFSIVMTLLIFGITLPSTEILTDAGLSSFISSILPNIGVTLVSFILLASFWIYHHEFIKLKCLNLVYLWLSMFYLATVCFIPFTTTLIGTYPEFRLSTNIFGINILLVIIFFLLMLNYASKRGFLDEEVIEKDKKYVHHTLYIILGLAVIINLLDFSVNENFIYLFFLVPIISTIRDVRFKLKNTE

SEQ ID NO: 7146 - protein, 686 aa, Methanobrevibacter ruminantium
MANDNERLQQLVRSSLLENNKLKMEIVKLKENENSLKSDKEFDELKKEYEASLSEKDQEILDLKDSHQSDLDELKLKYDDDLKTKENEISALKIQHKQDLENKSTEISNIKVKHNDELKLKDSEIDQLKQKHDEELRLKDNEIIDIEYDFDNKLKLKDSEINSLKEQFNQDLKSKSLELADFLEKFDEDIKSKNDEIDQIKEDYNKEIISKDMEIESLTNSLNANIEVLNKSKDLLSSKDETIDKLNDKVKELSDMNDSLSNMKESFDAELTNFKTLELGELNLKLRNALNDITSKDNEIQSISNDLKIANNDIVDLKRQLNESKTNANELNLKLATALSSLDDKNIEIQALNNRIASQNENIIDLKNNLVNKDNLVALQRELDSRDVAIREKDVQIQLLKDKSVSREEYAKVKNELSKKDLQIKRLNEVKDLFFELSDNSFMDSQSSSVVNKTSSDDKSLMELNNIKKELELAKENKVKFKIVEENLLDDEKASADLDKKVKLDESKLNTDLEELVNSEIDNFDDLVKSRDAKAEESKSTDASSSKGDYTSSQTNLAGLESSKAPQSDNAEIQKLKEELESYKKQEAEYKKQQEELNKYKDVYEKLTSPQLKNLNSIQSQIYYLLPDEAMDTLSIKDYLNEVAFKNLSFGNTKNILKSLERKGYVEVVKKENDIFFWKKLPIPAE

SEQ ID NO: 7147 - protein, 51 aa, Methanobrevibacter ruminantium
MIYMMNLRESLTHMRSNGLPLLNQMKVNLSVDYYNKYILTHKKTYFSKYYS

SEQ ID NO: 7148 - protein, 213 aa, Methanobrevibacter ruminantium
MAMDLTDIGIEEGQKYEGIYTTMSKDGVKNAAPIGIVCKGKDKLGCRLFVGTKTLKNIMETRKYVVNITFDPINFVNSTIGNLDIEEFTDDEDIAILKNAEAYVICEVTDIRKMDPIKDHITSNGEAYIISSDVVKIVKNNPCAKALNRGVFALLECLTNYTRLDLVSKEQQDYFIGRFNENNRMIKRVSGPDTIKAMEILKNSMIEKGFDVE

SEQ ID NO: 7149 - protein, 356 aa, Methanobrevibacter ruminantium
MSRNFKYLDDLILRKDKKIVLDFDIELTEDEELEYWDGIKLDKDVLIDGKGHRIDACGKARIFDCSGKHIRLKNIILKNGKAINGGAIKISKDSNLEIIESKFIYNIANGTCNEGNGGAIFNKGNLKLLKSTFENNMAKGEGGAIRNYGKLNIAESIFNKNKAKRGAAIINRNDLTISKTIFDDNTAEWYGGAIFHNWGQASILESEFINNSVTEDHGNGGAICNWMRSQLNITKSSFKQNISGSAGAIYNASDCKLNISQSAFKENSARYAGAIVNYGKASIQKSVFGANKSNKFEGGAIFNYSEGNLIISQSVFESNISERVGGAIYSENDNSLKLNNCKFKHNKPDNFNVGSK

SEQ ID NO: 7150 - protein, 321 aa, Methanobrevibacter ruminantium
MKHRLNLDNKDPNYILLKEIFKIMDSRKSKSILASYGFKNLNRTIFTFKIIFISMFFGIDIPFILNELKSKKELRKYFNISEVLTADQVYKIFSEINSEKLIKCLNRILNSRNMVKRRGKKTFIVDATPVDLDINFRRNKKSKEHLRKLNLKWSYSSSKGYYIGFKATVVMDYDSMNPVCILIHSGAPNDAGLFEEILENLQKRRIIRKGDTLIFDKGYYGYKNYQIGIGKYKIVPFIFPKEKFNRTRLDDILTYPLAVFNKTKKIMEEKRLYNKLKKELLEKLDSWEKFKPIRGKIEDFFQIIETRLEYERNPQIYSKIS

SEQ ID NO: 7151 - protein, 100 aa, Methanobrevibacter ruminantium
MSQERYKHIRESLFDYINAFLINKYDELYYFNMYESAENMNWDVEYIFKLKYSLTFHEKKNLEIRIRKDLKKFLKEKFEMNIYELAILIILEDNELHSKI

SEQ ID NO: 7152 - protein, 79 aa, Methanobrevibacter ruminantium
MFYIEGENIKYEILPYKKGKKVIIYLKKTENGFVRKNKCFGTHYLEQIFDYNNKLLKETIYENPNFVDLTNFPIDLDYD

SEQ ID NO: 7153 - protein, 49 aa, Methanobrevibacter ruminantium
MNLEVFKMARILIPNYEFVKNWSEDELNDFLTTPAGIPHELMHIVRKVV

SEQ ID NO: 7154 - protein, 244 aa, Methanobrevibacter ruminantium
MECYHLLRKENYSLVRKKIENFLEKYPLKISEENYFYFNNKFEENFYFIFFIHSKYVNVSQKEDVLKNYKILKYDYPFILAAYGETLIEFDEFSKAKYFLELANKISPFDIGILRQLLRIYCIELDREKIEEIFNYALDIVYDEYYLFYIYEFLSEYYLQINQIEIGNLLSQIAKEESFNVAEKHYIKDLFNKYDINLGFNEELISHMEYIVNLLNKKGDFTESYLLNQDCADLKRFNRKFKYY

SEQ ID NO: 7155 - protein, 134 aa, Methanobrevibacter ruminantium
MSNIEKINSEIKDYVNYVQKGGKLEPFFEDICLVTTELVGFRKISNFEDLFSQFKKGDYLALFRDTQNELDELAIVVKWNNLMIGYVPRKHIPILSSLMDSGKEIYAIIDDLILDELFKDLFFETVKIKIFLKE

SEQ ID NO: 7156 - protein, 252 aa, Methanobrevibacter ruminantium
MSMIVHSEYKKLKDHLYDLVYEYEDLINHICPNIEMEYLLKFGIYEYELYKKELELNKLKFKLKLLQTEINHQNELDLNEIDKKVIDKYTEYANNLKNSMNELENIIKHKDNYFQLDEEDEKELKRIYKILIKKLHPDLNFHQENFKKELFIKVTNAYKNGDLEELKALYAMLPDEDIEEKSSLNELKELIHSFEIKIEKIKNEYPYNKLDLLSNEKEIGEYKINIQYLIDSCNEEIEEYSNKINEIIENQH

SEQ ID NO: 7157 - protein, 349 aa, Methanobrevibacter ruminantium
MVKVGVLGATGMVGQRFIQLLADHPDFEIAALAASSRSAGKKYEDATTWYMNDEMPESVRDIKVIETDPAHMDKDVEIVFSSLPADFAAKVEPEYAKDFVVASNASAMRMKKDIPLVIPEVNPQFLDMIEAQQKNNNWDGFIVTNPNCSTIALTLTLKPIYDNFNINRIYVSTMQAVSGAGYNGVPSMAILDNLVPYIGGEEEKMESETLHLLGSLDGDEVVPANFSLSASCHRVPVIDGHTEAVFVELDEEADIDKIKKTMADFRGLPQELGLHSAPEQPVIVKEEDDRPQPRMDRMAYGGMAATVGRLRKDQAFDNSFKYVLVGHNTIRGAAGASILNAELINKQIL

SEQ ID NO: 7158 - protein, 272 aa, Methanobrevibacter ruminantium
MIKVAVTGASGRMGSGIIRKISEQDDMEVVAAIEMPNTPLAGVDAGEKAGIGKIGVPIVGSEDLEKALEESGAEVLVDFTIAPAAVETIKRAADCGVNLVVGTTGFTEEQAQGNADVIKEKNIKAVISSNFSIGVNVFFKVLKDLTPILNDFDIEIIEAHHNQKADAPSGTAMTAFEVVAGALGRNPEEVGVYGRQGQVGKRTKEEIGMHAVRGGDIVGDHTVLYVGDGERLEVKHMAHTREVFIAGVIRALRFVGSAEPGKVNDMTDVLGI

SEQ ID NO: 7159 - protein, 297 aa, Methanobrevibacter ruminantium
MRFEGTAVAMVTPFHEDGSIDEEGYRQNINWLIDNDVDGLVAVGTTGESATLTHDEHRKVLDILIDEVDGRVTTIAGTGSNATSEALDLTKYADDAGADMALLITPYYNKPQQHGVIEHYTQIANSVDIDLIAYNVPSRTSLDMAPQTIVELAKVDNIAALKEASSDVDKASKTMKLLRDEGLEDEIVILSGSDELTLPLMSIGARGVISASANIDPRTMVQMVNNILDGNYDKAMELHYQQYDLIKALFIETSPAPAKEALNMMGMPAGPLRLPLVPMLEENKAILRKALEDAGIL

SEQ ID NO: 7160 - protein, 405 aa, Methanobrevibacter ruminantium
MGLIVAKFGGTSIGNGKRIRKAAQSVVNEYMDGKKVVVVVSAINKTTDELVAIADESIGKEVTEKQLAEILSLGERTSIRVFSSVLESLGVKSEYIDPSHELWPVITDDNYGKAQIDFERTEEQAQGLLSLLEQGIIPVVCGFLGRTENGEVTTLGRGGSDVTAFLLGHCLKADNVIIVTDVDGVMSTDPRKIDEAEKLDYISVEEMRDLATHGAQVLHPHALRFKDPEIKAKIISFEKGDLSDPGTEIVGPFEDSMGKKVCLHHEPISVVAVVGEDLLNQIGLLAKMTSLVADANINIYGISAGQNSITLFLDKEEADDAYHLLHDLVIAEDNLSSISLGRDIAMLTMINPDFIETPGVITEITNPLKENHINIVEISSSQTAIVLFINWEDGKAAYDLIKEVL

SEQ ID NO: 7161 - protein, 65 aa, Methanobrevibacter ruminantium
MGNIRTSFVKRISKELIETHKGKFTTDFEENKILVAEYSTVSTKHLRNKIAGYITRLVRQEANKA

SEQ ID NO: 7162 - protein, 107 aa, Methanobrevibacter ruminantium
MDEKELMSIYETEEEARNVLLKSRKRIDEIDNDLVNLISERTSLAKDIVSAKVFLGMEIYDKSREDEVHAKVSKLAQEKNIDDDILSDIMNMLTILSKNKQREFLEE

SEQ ID NO: 7163 - protein, 289 aa, Methanobrevibacter ruminantium
MHYINAKTILSSKNGMNLYRGCSHGCIYCDSRSKIYNMNHDFEDIEVKENGIRLLKNALKRKREKVMIGTGSMTDPYIPLESNLKFMRESLELIYKYGHGFTCITKSDLILRDLDLIKKINENTKAVVQMTLTTADDELCKILEPNVCTTKERVNVLKTLNENNIPTIVWLCPILPYINDTEENINQILDYCIDANVKGILCFGMGMTLREGNREYFYKKLDEHFPGLKERYRRTYRNSYGIKSPNNKKLMKIFLQRTDEHGIMNNIEDIFEYLHEFPSHESTKQTTLM

SEQ ID NO: 7164 - protein, 305 aa, Methanobrevibacter ruminantium
MIDLAKIVKSPGSATVINAISTGFGSAFGIDLNITCEAEFSSQGIDCSSDLGVDPNLMNICVKSVLSHYNIGKDLSQDDLLNDLDFGNGEGIKIRTKSNLPLGSGLSSSSALSNSVVMATAGLISDEFFLKPLSDFEMINLGIDASLEAGVTITGAFDDASASFFGGLTITDNMERKILHQEKLPEYDILVFMPDKESLSGSSDVNRMKLVGSYVKMAFEEAMNKRYLKALTLNGLLYGTALNFDNNIALDALSAGALASGLSGTGSSFVAIVEEDTIDDVKDAWASFDGNVIETKVNNEGTRFI

SEQ ID NO: 7165 - protein, 83 aa, Methanobrevibacter ruminantium
MVYKVEVFTSPTCPHCPGAVRLVEKAKEELGDALDVTIYNTAEAEAMEIARKYHIMYVPTIIIDGEIKFQGAPSYDELMAELK

SEQ ID NO: 7166 - protein, 156 aa, Methanobrevibacter ruminantium
MGEKEFTHLTESGVHMVEVGAKAQQRRTAIASGKIHLQKETIRMIENAEIKKGNVLTTAQIAGIQAVKKTSDLIPLCHPLNLSGIDIEFEVEEEEITAICECRLTGQTGVEMEAITGVSVALLTIWDMTKAVEKDENGQYPNTRISDIKVLKKEKI

SEQ ID NO: 7167 - protein, 690 aa, Methanobrevibacter ruminantium
MKNIPTNIKQIINDCYPYIKEFNPAQKAVIESGYLENDKNYIIAIPTASGKTVLGVMAALQSILSGGKAVYAAPLISIQNEKVKEFKKFEEHGISVGKHPSSSDLSIMVFESFDVLTRFSWDVLRDVDTIIIDEFHMIGEYSRGPTIECAITRAKIINPNLRIIALSATLENMSEIENWLDATVIEHDYRPVPLNKDVLDTEMFNTKNKNDVVVKVIEKAIEDDSQALSFVSTRRFTESLANYVAEKLKKKTTDEQKKRFKEVADKILEVPEKKGSRPTSTCLKLAESCENGAVFHHAGLFSEQKEIIEEEFRNGNILMIAATPSLMYGVNLPSKYVVIRDYTRWTSQGPQAIPVFDYEQMSGRAGRPQYDNAGYSYLIAKSMEEASTLEERYIYGDIEPTNSKLIENKDAVFRQIIAQVASTISKTPEDLEDFFKKTFYGYQMTNNSSMSFFAEESLKFEIQNALEFLLQNQILQATPSGLKTTALGNLIAKSNYTVETAVKVKEYANLVDQFSAEELIYHLAQTPDMPLISFKGRRSKDPVREKLANYGLFALEIANPEATAVSLIEWIDERNEYEIENAYNVYASSTRRAAYEASLLVRFTKNTLEVLGKYNYSKDLDFLSARLYYGVKEDIIPLVIGVKRLGRKRARALVNTFGEDLRPVSENELQKVDGIGPKLAKSIRNFADNY

SEQ ID NO: 7168 - protein, 100 aa, Methanobrevibacter ruminantium
MSFCDIRGETIDIGAFIRYTGTGTISKVVDLKEEDKQQWVKLDEPALWYAADSLEVVDEKDLINVETVDRDTLEKVKDIKEGYEELNANLNDIQGCEGGG

SEQ ID NO: 7169 - protein, 151 aa, Methanobrevibacter ruminantium
MKIKQLLGMLVLDDNANEIGKIIDADFEPETGAITKIVVSLKKNFLTSDQLDVEYNDVKSIGDYVLLKITIDKETKIKEAEEAKKAEKEAKKEAKKAEREAKKAAKEAEKEEAVAEQIEKQVEVVEAEIVDDAEEAEEAVEAEETTDVKVE

SEQ ID NO: 7170 - protein, 568 aa, Methanobrevibacter ruminantium
MDKACRIIIEDIMNGKITTRRELEVEKRQLCRDRKLKKFMSNSVILEHASLEEKKIVSNLLRKKPTRTISGVAIVAVMCHPHQCPHGRCFYCPESDIAPPSYTGEEPAALRGRMFKFHPYVQCYNRLKQLHKVGHPIDKVELIIMGGTFPSKDICYQEWFVSQCLKAMCDFGIILENISQIDDIESIKREGLLKYHPYSNNELKTYPPNDYVLIDDIQRINENSKVRCIGMTFETRPDYCKEPHVDRMLDMGVTRVELGVQTIYNHIYEKIKRGHKVEDVIEANRILRDSGVKVAMHMMPGLFPLARENPRIEQCPEQDLKMFKEIFNNENFKPDMLKIYPCLVTEGSELHKLYKEGKYRPYTDEEAVELIVQIKKILPKWVRTMRIQRDIPSTLIEAGVKKSNLGELVYNRLEEEKINCQCIRCREIGHKKTEQDYSIDDYRLFQEDYTAVGGKEHFLSIEDKNEESLAGFLRLRMPTEQAHREEIRDNTAIVRELHVYGNMIKIGHKGNAIGQHTGFGERLLKKAEEISIDQNKEELLIISGIGARNYYRKFGYERKGPYMAKKLI

SEQ ID NO: 7171 - protein, 240 aa, Methanobrevibacter ruminantium
MITAEELAQYIEFTNLDNTATEEQMKAFFDKAKEYNFYAVVVLPHYVKLAKEELKDTDMKVVTVVDFPLGAGTTESKVAEAKDAIKNGADEIDMMANIPAIKEHNFKAVKEDIIAVKEAVGDHILKVIIENALLTVDEKAGASAMCEAGGADFVKTSSGFNGNEHFYALMESLRIMKKNAPHKEIKAAGGINNYKLVNNVIAAGVTKIGTSSGHIIMDQFNHVMDNQKVSPEQKTGPRLI

SEQ ID NO: 7172 - protein, 66 aa, Methanobrevibacter ruminantium
MSELPIAPVGRILKNAGAQRISDDAKVALAEALEEKGDELAKKAVNFARHAGRKTVKAEDIKLAIK

SEQ ID NO: 7173 - protein, 428 aa, Methanobrevibacter ruminantium
MDNMKVFIETYGCTFNQADSEIMAGILNENNIGLVSTEEEADAIIVNTCYVKLPTESKVINRIKNLQKQYPDKKIIVGGCMVEVDPKKLEAIGPNCSWIGPHQLNKTADVVKSTIGGEIVREFGFSDEPKVCVPKIRKDPYIHVIQICEGCLGACTYCCTRFARGHLNSYPIKDIVEEARLAIEDGCVEIELTAQDTSAFGKDTGEKLSDLIKEVASLDGDFRVRVGMMHPRNIGNDLDNLIEAFKMEKVYDFIHLPIQSGSDKVLREMGRNHTVDDYKNIVYSFKQAIPDITIATDIIIGYPTETEEDFMKTAELIREIKFNLIHLSKYQHREGAISSSLDNIPFDDMKRRSKYLSEIKFEMLEEENKFLQDREMDALVVEKGSKGGFIAKTNSYIPVVVQDVNLGEFIKVHIDKTTGTYLIGHKID

SEQ ID NO: 7174 - protein, 210 aa, Methanobrevibacter ruminantium
MVCPVCGSDDAIVLKNKLIDAKSKEIRELLLKCGECGSVYKERLTQDKPKPFRLIISEHEDTHKVSIDLYPDEELRVGDFLMSELGEVKITSLELPDEKRVQKAIASEVKTIWASSEEIPARFGVSIDLHGKVASFKCETDRDFKIAVDDIIKIDKYVARVHVIKTEERKTTKGYAKARVIKRVYAKPVKFNHFDYDLSKFIVSFKPLNK

SEQ ID NO: 7175 - protein, 161 aa, Methanobrevibacter ruminantium
MAEIKGKVWNFGDNIDTDVIIPGRYLRTFNPNDLALHVLEGERPDFTKNVEKGDVILAGENFGCGSSREQAPVAIKAAGVDVIIAKSFARIFYRNAINIGLPVVVADIEADDGDIVSVDLENGIIINETKDTKVEFQAFKEFMVNILSDGGLVKHYLKTKE

SEQ ID NO: 7176 - protein, 326 aa, Methanobrevibacter ruminantium
MIIRAPSRLHMSLIDLNGSYKRIDGGIGLALKDPQFVLQSEETNEKGYTLEFADSISEDSREECIEKIPKAAEKIAELCDIESGFHFKVLEAYPPHSGLGSGTQISVCTAHLMTETVGQKYTSRELSTMVGRGGTSGIGTFAHDLGGFIVDGGHSLEEKPGFLPSSASKAKPATLIARYDFPEEWDILLALPEVKEHMHDQQEVNVFQTYCPIPKTEVEQVSHLILMNLLPFLLEKDIVNFGWAIKELQKVGFNKLEHSLDASFLPTMEAIDEAGAYGTGISSFGPTLYTVFDKNNKDIVKAAGEIVGEDRVKVVKAQNHGYVLEK

SEQ ID NO: 7177 - protein, 509 aa, Methanobrevibacter ruminantium
MFIKKTTSLCPHCLKPLEAEVYQEDGKVWIEKECPEHGVFKNTYWSDAELYDRVDQVDSITQDLENPMVNKVAKCPQNCGICSEHESYTVLGLIDVTNRCNLKCPICFANAATSKKLFEPTQEEIRQMLRNLRGEKPVPTPAIQYAGGEPTVRKDLPDLIRMAREEGFSHTQIATNGIRIAKKEGYAQELKDAGLNTVYLQFDGVTEEPYLVARNKNLLDVKLEAIEKCREVGLGVVIVPTVVKGVNDQQVGDIIRFAIQNIDIIHGVNFQPVSFSGRTPSDQVEEQRITIPDFLNLVEEQTDGQISKDDFYSATSVQPVSKFIGALRNEEPPVTLNCHQHCGSATYIFMDNDKIIPITRFMDIDKFLTFLNKYTEKLEDGGFAIKSRVLASAAKNLPKVLNEDEAPTGLDMKRILLDIFKTQSYDALGEFHINSLLISCMHFMDPFNFDTDRVKDCVIHYAVPDGRVIPFCTMNSIYRQGIEDEFSTPLNQKMTEFNDKTGEEEEDAD

SEQ ID NO: 7178 - protein, 100 aa, Methanobrevibacter ruminantium
MKLSEWIIINKIPNNKILTILEEYENIEAIEFNDPEDVKAEVEEHGLRYVAHKYGVNEKALKEYGWRFKKRDAKGKKREETPIIKTDEQKPLVDIFGDEE

SEQ ID NO: 7179 - protein, 340 aa, Methanobrevibacter ruminantium
MKVAGFDIGGANTDLAIIDFENDEIKEIKTDFEYLPMWSDNNRLGNVLIDLIEKICPLEEIDAVGISMTAELVDAFETKTEGVLDIATTCEKLFECPVAYIGVDKVLSLAELVQNPIEVAAANWIATSQIIAEIEKDCIFVDTGSTTTDIIPIKDGRECAKGRTDFERSATGELVYTGTLRTNLTSFVDSVPLNGNQYRVASELFASTADVYNVLGLISEDDFTCATCDGAGKSKEDSARRISRILCADLDILSKEDILEIADYIHKEQVKQIASGLKDVSDREGLTKVVVTGLGKDILCAEAARLLGLEVKSMGDYYTDDECTVAPAIGTAIMMKNYLK

SEQ ID NO: 7180 - protein, 388 aa, Methanobrevibacter ruminantium
MDLKDVTDDSILVFELFTASGIEDLSIVSEAVELIRSLVNDLKDEDTYVLIAEPFKNIFDDFDFDVKTITIDNLEEWLEENAYIFDRAMFIAAENDMNLYNLTKLLENKAVKVYGSDSYAVKLCSDKYETFDYLINRVNQPMTYNILLNKKTYWKRAIQIFFDKINGDYGDGSDNGAVPIMQKPKDIPVLDNSDRDEVKKYKLIAKPRFGVDCESLKIISSKRDIDELEEIYPEGSRFIVQEFIPGDVCSVTLISDGKNAIPISLNKQIVEIDENGGKYLGGYVPYEHEMKEKAFEVAKKACESIPGIKGCVGVDLIIADDVYLIEINSRFTTSYVGLSKVANINIGKTIVDLIDKKISIEELGEIEYKDKVSFYKDENGILDIKIGE

SEQ ID NO: 7181 - protein, 225 aa, Methanobrevibacter ruminantium
MNQELIINNKEYRKTEPLESLNMFKGQLYETIVTTQSNEHIKNAAPIGVICKDSNHIVIHLDNCVHTHRNIIENGELIVNITKDPLIFTYSTIGELDDEYFDEFNGFPLIKDSLGFFKAHVIKKINKKRENDFNDGIGHVVTCEVEDIFIREYNEIVPLNRAMNAVIESLVYYCRFDAKYKHMQKEIWTHMKELNRVAQKVGNEKEKKSMKAILDKMRENHDYLD

SEQ ID NO: 7182 - protein, 154 aa, Methanobrevibacter ruminantium
MEDVSEFKGINGQLVSFKNEVEGADKITFIGSPGVCTPFAELLSYAVRNKENHFIPLLDIDDAHQFEFKPYGMVLKDEVSNPRDADVVVLLGGLTMPKYEVAFDDLNALIGDVLKEDGKIVGVCFMDMFAKAGWLDKVDFDSVIDASILGVVKK

SEQ ID NO: 7183 - protein, 268 aa, Methanobrevibacter ruminantium
MADKDKIFEDNAYDDSEYIYNDTYEGSRNDYDVEYDESEDYEYEEPLISLFDIVKEYDKGKVIALNKVNLDIYEGEFVSIIGPSGSGKSTLLNMLGALDVPTSGEIFIDGLNIGKEKDLSDFRRETIGFVFQLHNLIPNLSVWDNVQIPLVGTGLPEKEMKKRANEMIDAVGLSDKKKQKPNKLSGGERQRVAIARALVNKPSIILADEPTGSLDTKTGSMVLNLLRAMHDVYNVTLIVVTHDMEVARMADRMITIKDGQIVKDVDNF

SEQ ID NO: 7184 - protein, 378 aa, Methanobrevibacter ruminantium
MRFISLIIKNPFRNKTRSFLSIVGIAIGIATIVALGLITTGMEQSVQTTMNEGAAEITVTNITSIGAGTIDSSLVDELKNITNVSRTAGILSATDQNFVDMASSNDMSSMESSTRLYGINRADLDLEGIKDINGSFFEEGTKQAIIGKQYAQMNNMSIGDNISALGEEFEIVGVFETGGVLADSGVYVSLETLDEVTGAEGKVNQVIVKTDEGVNDTVVADAIEDKYENLTTITSEEMSQMLDNVIGILDAVSVAVSALAIIVGAIGIVNTMVMSVYERTKEIGVLKSVGWKSRKILKMIIGETLVLTILSGIVGSAFGILIAEVGVRLMGDTDFALGYSPSTFIMAFGITIVVGLIGGIYPAYKASKLAPTEALRYE

SEQ ID NO: 7185 - protein, 290 aa, Methanobrevibacter ruminantium
MKRTALKIAYIGTHFHGFQRQPDVRTVEEELIYHLRKLEYIDDLKASRFRIAGRTDAGVHSLGNVISFQSEKEVRVNQINNSLPDDIQIIAWAPVRFGFKPRFAKRRWYRYILFEEDLDIDLLRKTAEVFKGTHDFTNFTKRKQKTTVRTIEDIRITKPIIDEEDKNKKSDFAHLNKSYSPIFVDIYGESFLWNMVRKMMRIFLDVNYGKLTLDDVERLLNPEEGEPRAYIKVVDAENLILMDIEYEGIRFRYDDYACERFRRYLIDNLFELQKTYSITESMLNCLDDLI

SEQ ID NO: 7186 - protein, 298 aa, Methanobrevibacter ruminantium
MRKEKESKESISIYDNYKIDMELKHTDKQYYFIFYKRRLFLINNKIPLVKDLISLNINDSDVKNSIYIGQFHSKDCFAVELDEEFDCEHYIKANDDSQFIELYFVFDIDEETYLVAGRAIQIIDWENTHQYCGRCGAKTVTSDIEMAKVCPECGFTSFTRICPAIITSIIKKDESELDQEGRPINKVLMARHSYHTAPRYALIAGFLEAGESVEEAVKREVMEEVGIEVKDIEYFGSQSWPFPNSLMIGCICKYKSGEIKVDENEILKAKWFKKEDIERPASEISIFSKLLKNFIENY

SEQ ID NO: 7187 - protein, 204 aa, Methanobrevibacter ruminantium
MELIAKNISFKYPSAKDYLLKDVSIELDNKKIVGLIGDSGSGKSTLCKILSGYITKYEGEVTFDGQPFHKKGFKPVQLIYQHPEKVMNPKWKMDQVLSESWDVDDATLSEFGIQKSWLTRFPQELSGGELQRFSVVRSLNPNTKFLIADEMTTMLDAITQAQIIDSVLKIVKERKMGFLLVSHDMDLVETVCDEKIYFKDLNKA

SEQ ID NO: 7188 - protein, 446 aa, Methanobrevibacter ruminantium
MDKLLDVENVSISFIQYTKGLNQRDLKVITDLTLDISEGEILAVLGSSGSGKSLLAHAIFGILPENARLNGKIKFKGKELSQADKEEIRGKGIVLVPQSVNFLDPLMKISDIAIGHCDSEEEKKEKKIKQREIFEHYNLGPEVDEMYPFQLSGGMARRVLVSTALLADPDLVVADEPTPGLDEKTVEETLNHFKHMKDDGIGVLLITHDIHAALEVADRIGIFYSGYVIEIALKEDFSGDGENLLHPYTKALYKALPANGFEVIKGHQPLHGEIVKGCPYYDRCDWRFDRCKEERPELMDIGLKKIRCFKYDGVTEDMIKDGAIEETAEANIEDAANEVVEKAAELVDESNIEESAEAVEGAEEAVSETEDAIEEEVAEAVEGAEEAVEGAEEAVEVPEEAVEEGTEEAVEESSEEAVEESSEEAVEESSEETVEESSEEAVEEGA

SEQ ID NO: 7189 - protein, 168 aa, Methanobrevibacter ruminantium
MDIKIKEIENDESQIKSVQEFLYAQIKIEYGIGPMPEFHYDIDGLKDYYILPKRNAFFAAYDGDKIVATAGVRAYDKDYEFFKGQYNEENTASIWRLMVDEQYRRNGLARILVKKIEEFAKEEGYKEIYLNTHRYLEAALPFWNSLGYTVTIEEDDYDETNHMIKVLV

SEQ ID NO: 7190 - protein, 230 aa, Methanobrevibacter ruminantium
MSLSIELEKYLKGNGAIEVGYADITNFTPKKGLNTGVVFFITYPKEVIRNMANAPTLEYLYELIDLNTRLDALGMICEEFLINKGYKAYAQTKKRLGGNFGEFNSFELPHKTIATRAGMGWIGKSALFTTFKYGSALRLCSVLTDAPLEIGEPIIKSRCGKCMICKEACPGGAISGRNWDYTLKRNDFYDDKKCEKYALIVSEENLGKPDTVCGKCIYACPHTQKYVKRT

SEQ ID NO: 7191 - protein, 186 aa, Methanobrevibacter ruminantium
MNVNIKELGNDPEEIKNVQNFLFHMIKLEFGYDYVPEWHQDIVNMEDYYINPERNAFFVAYSESGEIIATIGLRAYDKNFEKFEGIYSNDTTSSIWRLFVDRRYRRCGLASKMFSVAENFAKDRDYKNIYLHTHRTLEGALQFWMKMGFIITLDEGDELETVHMEKFIQKLKISPQAGILTYAIKL

SEQ ID NO: 7192 - protein, 241 aa, Methanobrevibacter ruminantium
MLTFIQMEFLKLKRSKIFLLSVLMAVLPALLMYIATFAFDEVQAFDALFTNVNMYMSVLFAVLIFAIIMAYLFGREYNEHTLKMMLTIPISRGKFLMSKYLMFLIWILILTVITSLSTMIFGFAAGLSGFTVNLLINSFAQLLFANLLLFLTFSPFVFISLFVTNMVPAMVGGASLTLVNMLVYGQTWAPYVPWVCPYLIASGEIAEYGINMLLPYGLVFATFIVGIVISYLYFTKKDVPL

SEQ ID NO: 7193 - protein, 355 aa, Methanobrevibacter ruminantium
MSQLINYYFIIKGDFVTDYVIETTNLSKKYSKKYVVDSIDMHVERGKIYGLLGKNGAGKTTTMCMLLNLVAPSDGDILLFGMNPKEHSKEVYSNIGSIIETPGFYENLTAYENLEIVSKLRGKYNPLIIKMVLEMVNLDHEKTKKFKDYSLGMKQRLGIAAAIMHNPELLILDEPINGLDPFGIKEIRDLLKRLSREYGVTILISSHILSEIENIADVIGFMDEGCLIDEITKEELHTRLNKFVEFEVSDIDLAVDLLKDTGFEENGDFTFARNIGNYIEDMNSLKSFESDGYVNSEDGFESSENAIGGTIHLLTNLDLRDQFNKLFVSSGIDVRKVNLCEENLEEFFTRIVSSA

SEQ ID NO: 7194 - protein, 251 aa, Methanobrevibacter ruminantium
MKNEKTENENNKNTSSPLVKYLFQTRFFLFGLTKKSKTIKKIFNKVFFEDNELFILPNKSTVNKSNTKITANIEIKESFQKDDSEFLPSEILKEIIKEANNIFIMNKCICRSSSNCKDYPHDFGCIFLGPASKKISSKYGKAATVEEALEHVDMADKLGLSHLIGRNKFDSLLMNVGPKEELLTICHCCPCCCLWKIIPDLDDEISNKIKRLEDVEVNALDDKCKMCKKCLEENVCISNAISLEDDKITID

SEQ ID NO: 7195 - protein, 39 aa, Methanobrevibacter ruminantium
MGCGHCVQACKFDAIRLNYSRKSVDSVINRIEELVDYKN

SEQ ID NO: 7196 - protein, 246 aa, Methanobrevibacter ruminantium
MSFQDNKMLIMPAVDIRGGKCVQLVQGKPGSEQVVIENPEKVAKKWEDAGAEVVHVIDLDGALESVTNIETIKKILNEVSVPIQLGGGIRSIEYAEELLNLDIDRLIIGTMGIKNPEIISKLSNEYGSERVMISLDSKDNKVVIKGWQEKIDKSASEISKEFQELGAGSILFTNVDVEGLLGGFYVDPVIDLVDSVDIPVVYSGGVTSLDDLKQLQTTGAKGVVIGSALYKDKIKLEDALKYQNIE

SEQ ID NO: 7197 - protein, 150 aa, Methanobrevibacter ruminantium
MKVMATGAFDILHPGHGLYLEKAKELGGEDAVLAVVIARDSTVKKKKRIPVIDENQRLEMIKYLKPVDEAYIGHDGDMFEIVEEIKPDIIAIGFDQGHDVNKLQEELDKRGIKAKAMRVEAHRIADLDSTCKIIKKIRNSDFEEDYVNCD

SEQ ID NO: 7198 - protein, 338 aa, Methanobrevibacter ruminantium
MVSIAIVGGSGYTGGELIRILSAHPEAEIVDITSRQFEGTPVHKVHPHIRGTDLVFRNKKPSELDADIIFTATPHGASMKIVPDLIETGAKVIDLSGDYRFNDIDVYEKWYGIEHTSDLKGVFGLPEIHREEIKKTTLLANPGCFVTGAILSGYPLSKAKLAERMIFDSKTGVSGAGVNPTTSTHYPNIGDNVNPYKVTSHRHMPEIQQELGAFSDVKISFTPHLVPVIRGILTTNHCFLVDGADITSEEVLDIYKETYKGEPFIQILEDGEIPRLSSVRGSNYAQIGCFEIDETGRLVIISAIDNLVKGASGQAVHNMNIMCGFDEKTGLDFFGMHP

SEQ ID NO: 7199 - protein, 162 aa, Methanobrevibacter ruminantium
MNRIILYYSEGGTTQQVAETLAINLRCDICRIRDLKSRDGYKNRLFSTFDAFRESKTEIYPPRLDLSEYDTIYIGTPIWANNPTPAIITLIDRYNFLGKDVVLFTTSTNSEGENTFNKMDMKLRARGARVVQEFNIKTKDKSLEMISEDTEKAIKNLDLELY

SEQ ID NO: 7200 - protein, 385 aa, Methanobrevibacter ruminantium
MFDKIMENHKALIAIPIILALLSLALISFNGIEQGVELKGGSLAELQLTGSTSVNDLESQLTKELNTNNIKVTSNGENKVTVELENNVNSSTFSKAIDGKAKVISYNEIGPVLSEEAMGQIYIAMLFAFLFMAVTVFIVFREPVPSVAIILAALCDILIALGGMSILHIPLSIASVGALLMLIGYSVDTDILLTTRLLKRREGTVDERARNAMHTGLTMSCAAIAAMGILYIVTVIIMPEATTLSNISAVLVIGLIGDILSTWLMNLGILKTYIDWRQSKKQDKFNIDAPKSNESKSKSKEEDGKSESKSFKDRFKRSKDDDSKDSESEDSSKDSESKDSSNDIDSSEEEKSSGKDKKSSKKTKSNKKGNKRKTKKSKKKGKGGK

SEQ ID NO: 7201 - protein, 413 aa, Methanobrevibacter ruminantium
MVIVVGTGAGGAIIAMKLAKANIPVTIIERGPYIASKDAYETYDMKYYDKRFESEQSLDLLKTTCVGGSTIVAAGNGVRVLEEEFKDLGIDLSKEYETIEELIGVHQMDDDHIGEGTRLFLESAKECGFDAIKMPKFIRDEDCKPCGKCSFGCPRDAKWSGKDFIDIAIENGAELIENAEVTKILTAHKSASGVEYIQDGQVKTIESDLVILAAGAIDTAVILQKTGIDAGNKLFFDPFISVGGVLKDIKYNTEVQMNGLAIGNEYILAPHFSSFISKYIKETYPEVEDKDILSIMVKVQDDMVGSVDIDGNVKKFNTIGDIRRLGQGAAAAGSILQKAGVDATTMTSTVFRGAHPGGTAAIGEVVDKNLKTEIDGLYLGDASVIPISPGKPPILLILALAERLANHLIEEVI

SEQ ID NO: 7202 - protein, 153 aa, Methanobrevibacter ruminantium
MTKVELKVKPIENGTVIDHIPANKALQVLKILGLPKKGTNVTLAMNVHSRLGYKDIVKFENRELAHTEIDKISLIAPDATINIIRDYEIVSKNKVRKVNELNGIIKCTNPKCISNTEEPLETKFYLVDSNPITVRCHYCERLVQYDEIYNQFE

SEQ ID NO: 7203 - protein, 2255 aa, Methanobrevibacter ruminantium
MKLNKFFIISIILIIFLSISAISAENTDNALSTDTHSNDNVLSTDSRSNENALTNENTLLTDTHSNENALTTDPLTKENTHSYKDSEKSLSSDAFNKTIYVNKTGSDEGDGSEANPYATLKKSISQLDDSDNAVIYIGPGNYTGENNSALEINLDHKDHDGSLSIIGDSNGGTVFDGENLNPIIISISEDSIVTLINITFTHGKNNMGSAIRSSGNLTIDNCIFTENYATNLAALYVDKHSPLTVMNSKFLENRAKQCADIYFSQNSEIILLNNLFEGSTAEYSYAYSPSVSLQTGKSLVKGNTFKNLTGAYYKGALYIAYNNGINIANITDNTFINCNYTGTDGAILFFQNAYLKNNKFIDCHSSTAFLYSNTEFNAYLSFEDAEIDGTTFFLKANVTDDMGNKVKNAKVIFYLNGENVGSASSDNNGVAMISIKKLLENGEYVISGTQSYSEINPFGVNVKNATARVNYDHSSLEVWVSTDGDDGSGNGSEDNPFKTLRKALDYGTASAVNLTVHVKNGIYNGDDNRDLSYSTLGKITIVGESYSNVVIDGENITKSIFAFSSTLDVTLINLTLINCPSTLINAYTLSMMDNIVINSGTIRAQTGNNGVTIDNLRVINGTDQAITGYNLRLTNSRFENCDGLTHTGLIWLSTNNNKVTYLENNTFFNNTIAGSAGGGAAYYIQSDLISINNTFDSNWITESRGENVAYAGGRHIISINDKFINNEVPKYVAQYRSIGNEECEIIVENITFINNKASGNGAGLATTGAIVKGGKFINNSASGNGGAIYLLNHDNTSSYCQMSLEDVIFENNSATCGKDIFIEGSSGNNIFTYLNNLTIVANDLNVTSLSDNLTVSVFHPSGAIIGGGEISFYLDGEYIGKSTLVNQNASLEYVGFKNNTIYEFTSIYEYASLNDTYIDGIVSTKIPYALENIELYVSDGSGDDENGNGSISNPFKSISKALSEGYQKSTNITVHILEGTYTGSLNSNLRIPTTVNILLIGEGAAKTIISDSSSDYFITALKGKCELRISQMTLNRAARDTQSAIYIEEESNVAIDNVTFIGGQGNYGGAINTAGNLSIRNSYFHDNGYADRTLRANAYYGGAICNDGTLIIDNTIFESDHAGRLSEIANQGTLYMNNSKVIDSINAYSINMDLVAIGAYGGQKGEITIENSQFIVSSKTINELNDRIYDPTRALTCLGIGSCQHAILINSTFIGEGAVFSPYVFGGINSNNLASGGCTMIPGDLEVYNSTFRNVQAVNIIYSRTDNVRYHSQRVFEGCLFDNVEYIIAVLNTGNFSVEMHDCVILSDDLAKIGFGSEKTMKMDISNNWWSSNDGSYDNATLGTTNYISNCVVKLKEISSETVHPESYLILTLNSSNRTGLLQDAILAFKAYDGENISDYDGALYPRNFEMSAINATLDDLEGTIINKAINPFEGVENSGYYIEAIVDNQKVNLTVHDSLSIGNAYILAENISINYNETQINVTVLEENGKRADGGNVSLKLHDKTYISEIINGTAIFDIDVLPKGDYLLNYSLNRPKVYHSISNSSNLTVIPFKINAYANASNIKVGEDAIVIAYLDKDAGGNVTLGEEIQKVNDGTATFIISNLAKGDYTYQLSYSGDEKYDNETFHVSFSVNLKDASISVENDTLDLFVGSNETIVATISPIGLAVNYSCSNESVAMVDENGVVSAVGAGMAVITLTVGDDVTYSKNSSSVTVIVSKIPTIIEIVNDTISLEVTDSLDSIASLNPEEGGNLNYAISDDLIAKIDNGQITALSEGSAIITVSFDGNDKYTKAQNKSIKIIVNLKEASVSAFSNIDLLVGENDTLSPKTSPEGLDVRYESNDTSVVLVDNGQAIAVGEGNATITLTVGGDGVYAENTTTVKVSVSRIATMIEIEKDTIELKVNEESPIGAILEPDVGNLTYSISDESIAKVENGKIIALAEGNASLSISFAGDERYIGTNASVEIRVNKINTILTETDITTTYKEEGYLIATLKDSQNNPISGAVLTVDLDGIKNYTTDSNGQIKIATNNLIPDTYTARISFAGNENYSSSNGNASVTVKRIGTKLNFNDMNTTAFDSNIEGRIGEYFYFQLVDCDGNPLANKKVIIGFNGVKYNRQTNETGWAKIQINLKYANSYTFAIAFLGDDNYSGSFNFAVIRVSQQTPKLTASSKTYKSSAKTKTLTATLKSSSGKAIAGKKISFRLNGKVYTANTNSLGVATVKVSLNKKGTYSFTAQFSGDSTYKKVTKTAKLTIK

SEQ ID NO: 7204 - protein, 456 aa, Methanobrevibacter ruminantium
MEEHIDLFKSILNKIEDKVDYADIRAGTGNNTSITMKDNQIQDINTGLSTVARIRVLNNGAWGFATTNDFSKLEEISEKAIKISNSLKGDITLAECDIIEDAVAIEQKIKLSDVSIEEKKEIIQDANKASNVGNVISTTVRYGDAESKTAFLSSEGSCILTDNARVSLSLNAVASNGELIQFHHDSLGGVKGFEVLKNADIESFGRKVGEKATELLDAKPAPSGRFTIIADNSLTGVFIHEAVGHAVEADLVLQDDSILHDQMNKKIGSDIVNIYDDSSNKDGFGYYPYDVEGVKTRKNQIVKDGDLISYLSSRESAGKLDIPLTGNARSSISDQPIVRMSNTYLQPGDLSFDELIEDIKDGIYLKGSRGGQVDTGKGIFQFNASEAYKIENGELKDHFRDVSLSGNILETLKCVDAIGSDFKLSVGFCGKGGQTAPVGDGGPHTRILNAMVGGSS

SEQ ID NO: 7205 - protein, 185 aa, Methanobrevibacter ruminantium
MLSEDDGKYLLELAKDAIETYVKEHDKIDVPSDCPEHLREKLGVFVTLNKNNNLRGCIGYPEPIFPLVEATIESAISAAVRDPRFPEVGESELDSLEYEITVLTKPELIEVDKPIDYLDNIIIGEDGLIVEKGFYRGLLLPQVAPEHNMDKEEFLSHTCLKAGLRPDTWLNKDTKVFKFQGQIFK

SEQ ID NO: 7206 - protein, 351 aa, Methanobrevibacter ruminantium
MMLPTIPTPDELLDKGFRRGKKAADLRRGEKMPKRLKGKRIEETRVITACQVIKDRLKMILDRTPEIEELPEFYQDYIDITVGVDDFKQALGAVNWAYGIITQLEKEYGAKIRKAPSERATGLRKQAYGRISSVVHKIEKDLDFLDFAKQSLRNMPTVDFDAISIVIAGFPNVGKSTLLTHITDAEPQVANYPFTTKGIQIGHFEKRWQHYQIIDTPGLLDRPIGDMNDIELNAMVALEHLADAILFIFDASETCGYALENQYNLLEEIKNVFDAPIIYLFNKMDISDYDGARHDYVQEYIDKTENPLLISAAEGEGLEEIIQLIQQVEKREIAEEDEDEYEDDENYFDLT

SEQ ID NO: 7207 - protein, 197 aa, Methanobrevibacter ruminantium
MAEDMSENIETKSDFKDKAEEFKAKAEARTEANKEKWDETYNKGKDVAGKVGENLSKTIDDTIIAMKAMQKNFDDKYQSYKETSATNKISVDLAETKDFYYLQAYLAGVAKEDISIEATDSSISINAELKNILCSIEEDEENPANLIITGVKTGVAERTIKLGAEIVKEEISAKQDNGILFITIPKKEIPTTKIDIE

SEQ ID NO: 7208 - protein, 67 aa, Methanobrevibacter ruminantium
MAIPKAPVNRIIKDAGAERVSAEAVDALVAYLEEDAAAISKKAIEYAKIAKRQTVKADDIALAIKNE

SEQ ID NO: 7209 - protein, 223 aa, Methanobrevibacter ruminantium
MEFYIINGGPRKKYNTAELLKKASEGIKDELKDIDEDVNIHQIHLYDLNFKGCKSCFHCKRIGGKYYAQCPIKDDLLELLPKVQNSDGIIFGSPIYFGEITGELRSFLERFLFSILVYGGESNAPKRMPMAMIYTMNVTEEGFNLFYGDKFDILENAMANLISKPYSLKVYDTFQFSDYSKYENYAFDPELKAKRKEEHFPIDLDNAYNLGKKIAQDSLKLNE

SEQ ID NO: 7210 - protein, 336 aa, Methanobrevibacter ruminantium
MRYKMYDEMMEQPEALRRTFASESENMANISKIAGSVETIYLIGCGSSISTCYSVRDALASVSDLRIEVFTGYEFVYNKKLNDGENSLFIATSQSGETADTLTALKRANEFNIDTVSISNEPESSMIKEAKYPIVTLGNTETAILGTKTYITQLACLYQILFPASGYEKTDEIMEQLANMPDLVQELLESTEEDNKNLAEELKDEEGFYCLGSGVNYGLAYKLAMTMLMEGAIKHACPLYSAEYRHGLIERAEEGVPLIFLDADLESDELTKRAIANARDELKANCIIYNLRDYADINPLLAPFVFVVPLEWFVYYLAHFNGEDPGSTRHIGKVRY

SEQ ID NO: 7211 - protein, 181 aa, Methanobrevibacter ruminantium
MNVDLSKASMNVGQQYEAILTTINNEGKTNAAPFGVRIIEEDKVMLKIFEGGNTIKNIKDNGEFIVNITNDPIMFSYATTTSIPDEYLSRINYDDHEFAHISNADAYFICKVYSIKEGMRKDNIKDSEANVIKADVLELKINSPCVRPMNRGIHALMESLVNYSRINIVDKDTQDFFYRKI

SEQ ID NO: 7212 - protein, 624 aa, Methanobrevibacter ruminantium
MDEKTIDYEGNIITVSAEGLDEDIEIGDITITDAEPPEGDLVITARILEVEIKEVYPAEIVIENGLFKDAIPIITDDDSLLDLDYDGVLIPGFIDSHCHIESSKLSPSNFAKVALTHGTTSVVADPHEIANVLGIDGVRFMIEDGNKVPFDFYYGAPSCVPATPFESSGAIIDSKDVAELLSHDEIVALGEMMNFPGVLAEDEEVIAKIKAAHDFGKPIDGHAPLLSGDDLKKYISYGISTDHECSNFAEAAEKKRAGMKIMVREGSSAKDMDNLFDADERFNYIIEEEMRGNIIADSTDEAMAVPPFDFLVCDDVDARDLSKGHLNKLVKKAISMGINPKEAIAMATFNPAEHYGLNCGSIDPGKIANFVLVDDLKNLNISKVWVHGELVVDDGEVLFDVEAPEIINNFDLDEVKPSDFDATMEMGYVSSLMDETTNVFVIEAYDGELITGKLEESLLIKNKVIQPDIDKDIIKIAVINRYGGNNITNGFIKGFNIKKGAIATTVSHDSHNIVAIGTNSEEMADAVNLIRQHQGGLAVVCKEDGIQDILDLPIAGLMSDKDAEYVASKLVELFNLVRGLGCTLTSPFMTLSFMALLVIPAFKISDLGLFDFEKFDFIDLIHNI

SEQ ID NO: 7213 - protein, 405 aa, Methanobrevibacter ruminantium
MYKREIELSGHIIDSLTLPKTMDIIMDNGGDFDILEFDIGKRKSDTSKAKIMVSAESPDILNSILDELNFIGVSISEIEEVNLVPSPKDKVAPEGFYSTSHHVTHIYYKGKWILVDKIEMDCLIVIDEENETASCKPIADLKKGDLIVVGREGVKITPPQRSRGKQGVFEFMNSDVSSEKPMMSIINDVATEIKNVKANGGKIALVGGPAIVHTGSAPIVAKLIKEGIIDVIFAGNALATHDIECDQFGTSLGVKIETGEVVAHGHTHHMRAINRINKSGSIKAAVEDGTLKSGIMYECIKNDVPFVLAGSIRDDGPLPDVITDTAESQKLMRHYAQEVDMVIMISTMLHSIATGNLLPSRVKSICVDINPSTVTKLADRGSAQVVGIVTDVGAFLPVLYNALHD

SEQ ID NO: 7214 - protein, 204 aa, Methanobrevibacter ruminantium
MKKGEKRKQELLKIAYDMFLTRGYENTSVDEIIEKAQIAKGTYYYHFQSKEQMLEEVIDMMIDSEIETAKQIIGMDISVPQKIVGIIASMKPTEVEQPIKDTLFQPENVLMHHKVRKQLIDVLTPLLSEVIQEGVDEGIFECDNIPERVKMLLIISDGTFNEGTFSERDISVFIDMTEKLLGAENGTMSFIYDLIDKSEMEGAQ

SEQ ID NO: 7215 - protein, 69 aa, Methanobrevibacter ruminantium
MGLILFFLSYFLLFLFSQIHHSFYDIIIIASPICHSKSQGIYLYMMMFKLLLKNKNRPIVEKLFRRILG

SEQ ID NO: 7216 - protein, 324 aa, Methanobrevibacter ruminantium
MLFNTYEPGKFAFSHESVDYYDLINSEDNLNGSSDFSKSKKWGIIGVPFDSTCSYHHGSRYAPTIIREASFGLEQYNSEFDKLLDGEFYDCGDLNVVHGNCKRTCEILEDSVNDLIEANIKPIIIGGEHSVTLGSVNALSALEDKNNLNDITVIHLDAHRDIIDEYIGEKYSHATIMKRIYDLEPKELIQIGIRSFSEEERDFVEDKENIISFYAKDIKNQNIHLNEDVSTFEDLLSKLDSIEGKVYISIDMDVFDPSVAPSVGNPTPNGLFLADVQAIFEALSFNEEIDIIGFDLVELASDRLGDISGVLAAKVIYDFLTLFA

SEQ ID NO: 7217 - protein, 135 aa, Methanobrevibacter ruminantium
MSTKVVELKTVKVGKYIVLDGEASKVTSLTTSSPGKHGAAKARLEAVGIFDGQKRSLVKPVDTKVEVPILDKRVGQILAVMGDQVQIMDLESYETFELPIPAEFEDEIRGAVGTDLGVEYIIALGNMKIMRTKKV

SEQ ID NO: 7218 - protein, 153 aa, Methanobrevibacter ruminantium
MRIAIVSGNAEGPTELNAFDNALYEAKIGDVNLIKVSSMLEANTKIEKLPKLKAGSMVNCVLSSIVSSNPGENLTACVAVAIGDELGCAVEVDGIDKDPEDLKDEATKMVKYMMDKRNVKINELIVEEAHHTVKNIGSAIAAVIYITDDILEE

SEQ ID NO: 7219 - protein, 621 aa, Methanobrevibacter ruminantium
MNQDDIQICKEIATTVFKNVENLLDGQVGNPKAGEFVKIGADGTPTSHIDIIAEDEVIKLLKDADFESYLISEEIGELRLGKGKQQSVSLSEELLNNTPENKKEEEEIPRYIFLIDPLDGTSNAVKNIPAYGMSIAVANVPIGREATLEDVQLGFVKNYSNGNFYEAVKGNGAKENGQPLTPSKETDITKITLGGFTKSKTLSVSKLVDTARRMRVLGSVVLELAYIANGKYDAFLDLRGSRIIDIAASKLIVEEAGAIVTNKYGEKLNNRLSIYEKAVVVSAGNEDLHKQIIKIINNDELDKVTSVAIVSRVDEYKSVLFSLKIFETLIEKNIETVLETSLAEKLEEIKEDPELHKIIAKTMNETPEIAMHIESLNFNYEFMDYAKQLNELRTDIAIILGGDGTLLRTQNQLTKEIPIFGINMGTVGFLTEIEVENTFKALDAILDGEWSKEKRTQLIISHENESFRALNEVVIMTARPAKMLHYEVSVDGEVVEELRADGLIISTPSGSTAYSMSAGGPIVDPKVGAFIIIPICPYKLGVRPFVVSDTSEIRIKLLRQGKKAIFVMDGQIQKEVNYLEELVIKKSEKDVYFMRINKKYFYKKVKDKLNEGGLESINRVL

SEQ ID NO: 7220 - protein, 544 aa, Methanobrevibacter ruminantium
MNVFLVDLTHGGVKISSELSKSKRFEKVFAYDLYSTLKEEDEHLLKTYDVTILKDFDSFKEELKENSKELLKSEKEKENNSKDLIINPIHSSLNIKDLLNQITEEINPNNDLTHLYEIINHHQATKLVLENWKEETKKHDIKTIEITGVKGKTSTAFLLKEIFLENNQNTLLLSSLGAYLFRKNQDKEMELILQKNISITPANIINTIQLAKKIANPKCSYFPKCAANKNKQEENELFEEYNNNPYHNLNYDIAIFENSLGVCGLGDIGILTNLVENYPIAKGSSNAMEAKRQVFDCSLVIIEYETLNEFYKGESEEYKDKINSFSLNNNKANVFCKNIDFDIDNTQIKITYQDFKTRNKNTINGEFTLNCFAPGPHHVLNILTAVSTALALEIDEKTIIAGISKFNGIDGRTQVKTVENSIIIEEINPGINTKAIESSINMIKDIDNYYIIIGGKYGVTCEEIDEEKLSNYLNNYLTDNPNTKLILTDEVGKSLKEKLDLLNDKDEYEIMFIENYEEARDLAINENKNILFIYRSNYSQVSKR

SEQ ID NO: 7221 - protein, 289 aa, Methanobrevibacter ruminantium
MIVGTRGSKLALVQTDYIRQCLYNITGEEVEKNIIKTKGDKITNSQLYNMDSKGLFTRELDNALLDEEVDFAVHSLKDVPTELNEDLEIVAVPIRESPNEVLISNYSWSELEEGSTLGTSSLRREAFCKHHNKDFELKPIRGNVETRIEKVMDGQVDATIMAEAGLNRLGLQKYIKAKFPTDYIMPAAGQGALAVMTRKDSEHKETIRKLNHYFSHQEVLAEKTILEEIGVGCQWPIGAISGIKNNQLELKSILLDKNGEILYQKTLSGSIREAKEMGVQIGKEMIEFI

SEQ ID NO: 7222 - protein, 315 aa, Methanobrevibacter ruminantium
MRTINVGVIGVGAMGYNHARVYSKLENANLVAVADVVKPTLDKVCKKYNTKGYSEIEDLLKNPEIEAVSVCVPTTFHHEVVMQAIKYGKHVLVEKPIAFTAEEAQEMIDAAKEAGVKLATGHVERFNPAVQKAKELIKNEVIGDLVAISAKRVGPFPPRIKDVGVAIDLAIHDLDVMNFLIEEPVKQVYATMSSRLDQSDFEDHAEIMVSFEEDITGILEVNWLTPYKRRQIEITGTDGIITVDYIDQSIEVYGKFAQDIQIKPVEPLSEELNSFLTKIGNDETPEITGEDGLKALKMVLAANKSSKEHSPINFR

SEQ ID NO: 7223 - protein, 204 aa, Methanobrevibacter ruminantium
MNQELINRAQELRNHGFTTGEIADELNVSMDTARWLTLQKTEEPVETEAPVDIAINWNSLGGSATRLRYVSAALSDIALKHGDIDLVVGIATSGIPFATIMADVIEELTGTTTCVSIFHPKKHRTNPTNSDEGAISSNFGTVEGKRIVVVDDVTTSGDTIKDVIKVVKDHGGNPIVVTVLIDKSGLEEVDGVPIESLIKVSQLR

SEQ ID NO: 7224 - protein, 268 aa, Methanobrevibacter ruminantium
MEFNIVKELNGQFDPIVLIKTDEKPEDALAPKPGRGGCVMSFVAQSIAKRKVTAFGRENITCGGVSAGFGWGTGFKTDKDKEFQATFLSLGLDSAKDKDAFLERLSYLPKPTQEMFKKGERIFSDFDTAYENIQNRPLYDEGEYVVFKPIELLEEGETPDSVIFTANTMELSAILQLNGSFRAESAHIMTPQASACQAIGAFTFEQEDSDNPIPVLSPLDFAARAHMRRLIPDDYMNLSMPWKLFLKLEELSKNSVFQTHFWDDFGNK

SEQ ID NO: 7225 - protein, 473 aa, Methanobrevibacter ruminantium
MIENNICLLTDSYKLTHHYLHPKGTEKIYSYLESRTGAEFNKTIFYGLQYILKKYLEGNVVSEEKVLEAERIVDAHIAPGIFNTDDWMYIAQELDGKLPVKIKAVAEGSPVNVGNVLMTVENTDKRAYWLPNYLESLLLQVWYPSTIATLSAEVKKLCNFYLDVTGSSKDNLNFMLHDFGYRGASSTESSRLAGSAHLLSFSGTDTVPSLAIPVNYYNTNEIQGFSVQATEHSVMTAMGPEGEMEQAINVVRNAHDGILSIVIDSYNYKNFLENACIKGHKLNEEINEFLKRTEGNKIVFRPDSGEPISTTIDCLEIIERGFGTHNTDKGYKIFNENIGLLWGDGLDYQKIRDILFGIKAQGWAAENLIFGMGGGLHTAVNRDTQRNAFKCSAQLRDGEWIDIFKKPLDTSKKSKKGRFKLIRNDKFEYSTVPIETEGKDQLRTVFKDGELLIDDSFEEIKKRTETYNMFPIK

SEQ ID NO: 7226 - protein, 139 aa, Methanobrevibacter ruminantium
MEENNYIVFKKQYGNIKRPRTKEVSINQNGVKIYEKDQSMIINIVLPIEDSMKVYQFFEEFNLGEDIQFNISNTGDFECVFRGISSVIDKDSYSSFSITVQEKYQRPDQLQVEADCNQVDEYGNPIQQCIGCGLHRDEI

SEQ ID NO: 7227 - protein, 312 aa, Methanobrevibacter ruminantium
MIDEIYDYYEKRLSTSNSILKMRGIDEEINKLPLGINLDIANILSTIDIYDYDEKKAAKKIKEAYVEVFKEGIYLGIGFGKILKFNYAKSHPENYVECLEEDYQHFTFYDFKIEVLKKIIPPIKVKKFTQERHPKEINYRNESFEDIRSYTCINVETQWEDKFDFEVNPDAKEMEDYIRQREVKSYEDNEELKKCVDDLKMGIQNILFQKFFEALEVDLEKAENGCENNLRFDEETAKDVFISPVFSNLEGEFKIRELVNKYLIHVFNEGKIIGLLNGIKIVLEDIQNDRLDYEEMNSMSSRESFLYIKEGL

SEQ ID NO: 7228 - protein, 281 aa, Methanobrevibacter ruminantium
MINEIVNGYKNQQKVYLSSIIKTLNLDIPDVLSVYPKSNHDLDKIFKEIKLIDKDENILEPLEEFYIDTLKRGILSSIPLGKSFMVKLHRDDEEHFNEVLRMNSGLFLNYVPKISSLEDLEKCTPKYGERDYYKMKEEEQVIVIVEGILRSFCEFTTDNNLMVDYHFEELFDVLDIDLKLAKKRCNKRIKLGNKSKIGIISAIYKNKNGKFRVTDLVKEHCQTIFEEGMRLGIRNGIKIVMDDVHSKRIDPDDFSTMELNELSAYFYKEINEELEQLARNC

SEQ ID NO: 7229 - protein, 407 aa, Methanobrevibacter ruminantium
MQKDNSNQNNDLKQGISDSNQEKDLNHKTNNSNQNKDFNNRISNYNQEMGFKNKSNNSKQENDSKNDLDSNKNINPFKQKDDDFDKALDKNYLEEYNTQYYYSISQCTSLDNSSQGRLVSNILLNLIESLENYLLKIARIDYINSYFDWDFHLLNSSFENAFCMPGGKVLVYSGILSIADNEERIAYILAHEMAHALLNHPRDYIIVKDKEYNNVLLFKPFSLNQEFEADRLAMMILKWADYDIGNIPSFCQFLRGNYNKFNYFSTHPLSDDRLMNMESLIAEINNLKDDCFAPIIKNDRSNALIYTKRYAGSQYNDKDNEIEDRPKVFCTNCGYYEDSDAVFCSNCGSRMDDKSRCDRCGALIDPGDVFCTNCGNVLVDDYKCFNCGHKIKPGDVFCVNCGIKLIR

SEQ ID NO: 7230 - protein, 132 aa, Methanobrevibacter ruminantium
MATFSSIEEAREFFKGDKFATNIGVQLDELEDDSCVCSLELCDDFRNAYGAVMGGAIFTLGDFAFAVLSNQLHRPTVGLQVSINYLSGAKGEKLIAKAHYKKNGRTTSVINVDIIDDTGREIAQFVGTGYKM

SEQ ID NO: 7231 - protein, 335 aa, Methanobrevibacter ruminantium
MKDIFDECQFGEFKLKSRIIRTGGWERDTEDGGFLKPKVFDRYEKMAGNEVGLIVSEMFALDPKDRFYPYCANMNYKGFIKDYKQVTNLSHHFEVPILGQLAFFFFDDGTNQKAEPNDISLEGIRKLQAEVVMAAKKFSFAGFDGIQINMAHNFYLARFINPYFNQRTDDYGGSTEKRMRIVVEIIKLIKKMVGCHVSFRINAVDGRKGGMTLDESFKIAKILAEAGADSVQITARTISFKFGETGDHAFLSYADRMAKELDIPVILGGTLRDMKTMNEILNETDIEFLSLAKPFVAQQDFLSEWKENGDGVSRCRACNNCYGKKESNCFQFGDE

SEQ ID NO: 7232 - protein, 191 aa, Methanobrevibacter ruminantium
MLELDKLLDIFNAGDTLVMDEEATDACNYYSAEAQKITCELNYQYNDFDKRRELFSKLINQELDDEFRVFTPFFTDFGKNIHLGKNVFINAGCKFQDQGGIYIGDDVLIGHNVVMATLNHDENPNNRANLIAAPIRIGNKVWIGSNATILPGVSIGDGAIIAAAAVVTKDVEENSIVAGVPAKFIRKVKTD

SEQ ID NO: 7233 - protein, 111 aa, Methanobrevibacter ruminantium
MAIPKAPVKRIMKEEGAERVSAEAVDALVDYLETDADAIARKAIDYAKLAKRQTVKAEDIALAIGRPETSESTAENPHNLLEVVQKVLDAAADGKGFEEIIKSFMKLEKKE

SEQ ID NO: 7234 - protein, 444 aa, Methanobrevibacter ruminantium
MSYVDEVIDLIVKENPDEPEFHQAVKEVLESLRVVIEENEEQYRKDALLERLVNPERQIKFRVPWVDDNGQVQVNTGYRVQFNSAIGPYKGGLRFHPSVNVGIIKFLGFEQIFKNSLTGLPIGGGKGGSNFDPKGKSDREVMAFCQSFMTELCKYIGADTDVPAGDIGVGGREIGYLFGQYKRIQGLYEGVLTGKGLTFGGSLARTEATGYGLLYFANAMLKANGETLEGKTVIMSGAGNVAIYAIEKAYQLGAKPVTCSDSTGWIYDPEGIDVELLKEIKEVRRERLTAYAEARPSAEYHEGKGVWTVKADVAFPCATQNELDIDDAKTLVENGVIAVAEGANMPTTLEATEYLIENGVLFSPGKASNAGGVATSALEMSQNSQRLSWTFEEVDSRLQTIMEDIFANVDAAAKEYGFEKNYVVGANIAGFLKVVDAMNAQGIV

SEQ ID NO: 7235 - protein, 182 aa, Methanobrevibacter ruminantium
MKILISNLKGKELVEIAMKNQIDKLISVYSNYNETSLLDQYMTKENIKISTTNAIDACKQLTDIIRHQDTDDEIYVASDGNFLGSMLNFVANKEAADYIFYSFNNQIIQMPRLSINLSETKMKILKSLNETEQTAILIGKNIGISRAMVYKHINSLMEDGLVGQTKQYEKYYLTNAGKMLII

SEQ ID NO: 7236 - protein, 79 aa, Methanobrevibacter ruminantium
MAEDKQEPLSPIEEIKKEYLEKIDYFGNRRSKYALYKKFSKKYNLNRRVFIHILNEAHEDVGSPKRYELRRQTPKDYKR

SEQ ID NO: 7237 - protein, 279 aa, Methanobrevibacter ruminantium
MLIVYCLNFYMVFFMFYLVGLGLFDEKDISLKGIETLKKVDKVYAEFFTSRLFGSNFESIEETIGKEIIVLDRTQVEEESVFLKEAKEIDVALITGGDPLIATTHSDFLVECARDGTDFEVIHGSSILSSAPAISGLQAYKFGKVTTIPFPDLEYNYFPKSPYMAIEENLKNDMHTLVLLDIQAHKDKYMTINEGLENLMTIKDNLEREGMIDENSLAIGIARVGSKDNVVKAGYIKDLLDYDFGGPLHCIVIPSKLHIVEAEYLVHVADGPKEILDDL

SEQ ID NO: 7238 - protein, 486 aa, Methanobrevibacter ruminantium
MILNHYILSGINEKIGEMEEEFQLMLLASEIVDCCFNFFEIERKTSKVGRPHFEIKNMIKLIFYGYINKITSSVVLAHNAKYNFLYSFISHGCEPSDRTIRDYRKNFMSIFQLIMSFTLIATYKLGLSDFKYIAIDGTIKQAYNSPFNIIKEKDIRLLIKHYMVEELTKNEIKKLRKTAKKFLKDKTKTDEEKVDILFEWWRLLDFSGQSSLGLNDHDARWMKIKDKGQIYPKFSYNLQLGTDTESKLICGVNVVQNPTDHYQIPALMNQIISNLNLKPTKISADTIYLTLANLNYLDNLGITALIPTSQQNRENSGEKPNNRFAIGYFVFDEYKNVFICPEGQELTLDGIYQAHPEKGGGNKLKAVYSNFNACNNCINKGVCFKTGHRSITRYVHELAYKTERIISSEKGIEEYKLRSSTVESHNGTFKRVYLYDFIPITGLKRVQGLMFAIVASYNLIRFLNLIKENNMSLQSVINSIRYISSS

SEQ ID NO: 7239 - protein, 365 aa, Methanobrevibacter ruminantium
MLTIKIPVQNIEATRQIVLKHKILDYDYKIKVENGFGHIPIREETEDEILSKVIEECKEEIIKQNSDYTIEVVDLNQNEELETVKRYPRSITELLKDKLSDEEIEELKKSFDIIGDVVIVEIPEELEAHKKEIGEATLQFTKRKTVYMKRSAVEGITRTRQLELIAGEDNPITIHKEHGTRLKLDVKNVYFSPRLATERKRVQEETKDGEEILDMFAGIGPFPIVIAREKNVDITAVDINEYAIKYLNENIKLNKLQPNAHITAICGDTRIVADNELKGRKFDRIIMNLPGLAPDFLDLAVSMCKDGGVIHYYEFSEGFSQGIERAQIACEKQNKEVEILNTRKVKSTSPGMWHVVIDCKVSDKK

SEQ ID NO: 7240 - protein, 296 aa, Methanobrevibacter ruminantium
MTKKDITCGGDHKGARFAHITKVHPCYNEKLHDKVGRVHVPIAPKCNIGCNFCIRSINTDEDRPGVAGSIMDADAAVEHVLNVTKDSAITVVGVAGPGDSLANEATFEFFEKINKVKPDLIKCMSTNGLLLPKYAERIAELGVNTVTVTVNAVDPEILKEINGFIFYEGKVYKGLEAAEILSKNQLEGIKKITDLGVVVKVNIVLIPGLNDEHIPEIARTVKECGADLVNVLPLIPLNKMADYPRPGCMEIEKARGEVEEYLPVFRACTQCRADAYGIPGKKHEDHHIGNAPQSHF

SEQ ID NO: 7241 - protein, 188 aa, Methanobrevibacter ruminantium
MYIESNDPEGAKVYDMIIRQIFQDLVLPPSIDDMKAYVNPNEVCFIIAIKMRKTSQHITLKEVANVDYNAEDDTTVVIIDNENYLPNILKRLWEINGRENVHQPSRYVIHLPGEKNVSDLVVDDPHENLKRRIYDAVFRIVPEGFKIMKDMSEGDIVCIVATDELIKDEWVEKAKGYMVELNTPKTWD

SEQ ID NO: 7242 - protein, 411 aa, Methanobrevibacter ruminantium
MVQIALVSCGTEYSGIQKEIEKAALKFGAEIILPEIDLDYINEAYEKFGFSAQSSSLKLMIARAMSIVEGRCKPDAVFIATCFRCAEGALVRNEVRRFIQNNTRIPVVTYSFTERTKADELFIRMEALATTVTRRSILAREKQEGLTLGLDSGSTTTKAVLMENNKVIGTGWTSTKDIIESAKTAAAEAFDNTDYNWDDVDGIGTTGYGRFTMGREFGAELIQEELSVNAKGAVYLADCQKGEATVLDIGGMDNKVITVNNGIPDNFTMGGICAGASGRFLDMTSRRLDVDITELGPLAVQGDWRKAMLNSYCIVFGIQDLVTTLAAGGSKADVAAAACHSVSEQVYEQQLQEIDIREPLIQVGGTSLISGLVEAVSETLGGIEVIVPEYSQHIGAVGAALLVSGMGKRHE

SEQ ID NO: 7243 - protein, 168 aa, Methanobrevibacter ruminantium
MVKVAIYPPNSLILADLIERKGHAPLALQKQIRQKIKDPEIDSPPMNITEEDPINGLKYAAIEVPSGVRGRMSIIGPLIDAAEAAIIVDGAPFGFGCVGCARTNELSIFCLRKKDIPVLEVVYPDDEDGTVLMVNQIMEFLDSLPGGGGDMEGDNDVLGEQIGTKGGK

SEQ ID NO: 7244 - protein, 168 aa, Methanobrevibacter ruminantium
MPANLCITPDLGKEDMDPEVSTRMIILSSKANVSESEVVNFLHMLNLPLTIKWTCYGAMISGKDKYVRQAIRELRKLDPYGIFTKERGFAPGDPRRCRGHRYGPREGFHQMEKEFRILDYVGEALKNPRDVEIEKKEPVSVDYFKEVLDKALEESEGSSKEKSEDDNK

SEQ ID NO: 7245 - protein, 522 aa, Methanobrevibacter ruminantium
MKRGKPMLIKINGEDVDIPEGSTIKDAIELSNAPYKKGSIVCLIKGESEIQSNVLKYKIKTPKGSILIELEVSEKSKPLTDFFKENYSLFSSNNVRWETSNEVAIGPVESNFEPSHDEFRYFDNDVLISLSGFSKEATHIIFVKDDHSNVYGVPKYSDRGVFARIIGGRRTLFSLTDDDEILSIEPVIERSTVTDSTGGSNLEEVLEEGNQLFTYALLEPNAKSPASVEHLFSLIRNNKIQVDFESNSFLGFYELNGLTKDAEEISERKRGTVTLRSEGNGKGRVYVYREDRVRAETHTNLATVKQGMELFDTAKKGDFITVLSDPERIMLMMLTQKEAEEKMQSLGIKHVRDGNLDDDAIVVIQTPENTIDILENKEVTTFGLASDELVKIKLTDKAPRTRWYLEKISGLAEKPVGTLKVYFAVPDMNMFMFNGDTDESKGLIPENIPTDIVKAGEIAVTNMSRKNLGLIGIRTIDTDEFGPTGEAFSATNIVGEVVGNIEGLNKLKDGSTLYIYEVYDEE

SEQ ID NO: 7246 - protein, 227 aa, Methanobrevibacter ruminantium
MSLLEVKNLKKSFGDNVVLKDISFSVEKGEVLSIIGPSGSGKSTLLRCITDLETEDSGEINFDGTFGLVFQNFNLFPHHSVMKNITNAPLKVQKRDKAEVYEHARDLLKKMGLSDKEDAYPSELSGGQQQRVSIARALCMKPDILFFDEPTSALDPELTGEILAVIKDLAAEHMTMVIVTHEMNFARNVSDTIIFMDEGVIVEEGSPEEVFSSDNQRMKEFLGKFYE

SEQ ID NO: 7247 - protein, 325 aa, Methanobrevibacter ruminantium
MNFNELVKSLQEFIGVSRKNSIEKVTKALSETYNISGDVLLDFGDDASAIDIGNGQVVLLAADGIWGQLMSVNPYWAGYCSVLVNVNDIAAMGGRPIAMVNTLSINDDEIYDGVLQGIVDGCRKFNVPMVGGHLHPDAEFNSLDVAIAGIAKKDSLITSAGANVGDKVIVAIDTDGRQHPQFVLNWDTTYEKDAKLVQDQISVMQEIAEAHLPTAGKDISNPGTLGTLEMLLEASGVGAFVELERIPRNPDVSWEEWLMAYPGAAFVMTAKEENCQEIIDRLSPYSFEVAVVGDVIEDKMLVLKSGDEEAVLFDQRKNPVLVLGN

SEQ ID NO: 7248 - protein, 210 aa, Methanobrevibacter ruminantium
MTLLGHHIHDKLFLSKDTLEIPFDEEADSPENFKSIMFNVFKSYVIESIKEVVPSFVEKDHEYNVVNSYEGFVEEDYEFEDLDDFIQELEYGSYEGSNEIYVDEDGSLVEEVYIEDGEVPLEEVYIEYDDVPVEEIFVEHDSDDDIYVEHESVEEIFVEHDDGSIDEIIVEHEPNENIVYEDAPVEEIFVEHEPNEEIVYEDAPLEEIFC

SEQ ID NO: 7249 - protein, 413 aa, Methanobrevibacter ruminantium
MEIGVVVHGPGIIDSGWAIKIIDILSNYGNVHCRLGGTMGRTAVIDAALEDAIDISLKLLPSQSLELFNREGVDIIFLLNYGKSPETGRVFGYKVFNHYFKQISNEDYLATNHKPLYDASVPVIQIERPGEEDGSIISWNTELNEQLSKSRKGRFKLGLGKKNMVESLSFNFEELFDHLKTSLNLVEVTPEEVVSNYFSNNQERKDEEDIEKILRSYDDYDISHYTYRKIHGVSPDENIFINGIVVGYSNGDSIVLVARDGLIADIINGTIKYHGLEKLGPVDLERVIVKTGLLRKSDDVNPRVLSNKDISLKDTERHIYSGEISEDDYSFKVAYVDHAAYDIYKFKDFDLVVTIGDDTSLVASDILYRFDIPIIGITDGDLDKVVENGFVNEKSTIIEVASGFDDIAGPSHS

SEQ ID NO: 7250 - protein, 168 aa, Methanobrevibacter ruminantium
MSDLYYVLDASAFINGFEPKSDFNITVSEITDEVKDLKSRLILNQAIDDGKIIIQEAQKEFLDKLDETIAKSGDDLRLSGPDKKLLAVALALLDEGKEIKVLTDDYSMQNVLKILDIPYESIITEGIKGVYNWKKTCEGCKKEYPADYPFDDCEICGSKVFKRRIKTY

SEQ ID NO: 7251 - protein, 172 aa, Methanobrevibacter ruminantium
MKSETMELHKKKAPIKVSCGIITLSDRFSNDKEGKEKDLSGKYLIDELSKKYDVDDYTIIPDEKDILKDTIESMIDNGIDVIITTGGTGLESRDITIETVEPLFEKEMKGFGEIFRAISYEELGAGSLLSRATAGVYKKTLIFCMPGSPNAVKTGMKIFYEELGHLKKHAQK

SEQ ID NO: 7252 - protein, 176 aa, Methanobrevibacter ruminantium
MCMVSKEYLIEILKENKVFEQGEFTLASGKKSNYYVNMKRAITEPEILSTIAKLINEKIDDDTDKIAGPALGAVPIATAVSLESKKPLLMIRKEKKGYGTSKLIEGDLNEGDKVILVEDVTTTGGSLLKAINAIVDNGGVVQKAFVVVDREEGAMETFANEGITLEPLISVSEFFE

SEQ ID NO: 7253 - protein, 94 aa, Methanobrevibacter ruminantium
MRIAKELIGKEVLGTDVTVMGKVVDVDIDVEDNIIESIIVSKGGIQESLNISKSELVIPFDMISKIGDKILLKDAFGEDLDQMADEIQDLKNQL

SEQ ID NO: 7254 - protein, 549 aa, Methanobrevibacter ruminantium
MNYFLLGIVFIVYFLMVGYVGYLAWKRTNSSEDFLVAGRETHPYIMALSYGATFISTAAIVGFGGVAGKYGMGILWLAFLNILVGIFIAFVFFGKRTRKMGKNLNSLTFPEFLGRRFDSKFIQYFSGVLIFCAMPIYAAVVLIGAARFMESSLMLDFNLALFILAVVICGYVLFGGLKGVMYTDALQGTIMFIGMLILLVFIYWVLGGVTEANTALTNMAHLYPPDALAEGGTGWTSFPKLGSPFWWTLVTTIIMGVGIGALAQPQLAVRFMTVKSNKELHRSLLIGAVFIAVMTGTAYIVGSLCNVYFYQNFGQIAIDYVGGNMDSIIPTFISTALPEWFVYIFLLSLLAAAMSTLSSQYHTQGTALGHDIVDAFKNRGTTREYTDEEILEGSSKEETRIGFISVSQLGILIAVVLSLIIGLILPGGIVALGTSLFMGLCAAAFLPVYCAALFWKRATRKGAIAGLLSGTFTSLFLLVFVYKKTAVGLGICKALTGMDMLINVMPWYSIDVMVFAIPVSVIFTVVVSLLSPPMDEKVIKRSFEGLSEE

SEQ ID NO: 7255 - protein, 433 aa, Methanobrevibacter ruminantium
MIWNQNAECMDKEEKEEMQLALLQKQVKRVYEKVPFYREKFDKAGFHPDDLKTLDDITKIPFTTKADLREAYPFGLFAVSDDEIIEIHSTSGTTGTPVVSGYTQKDIDIWGECTARAIAMAGGDKNSKIQNSYGYGLFTGGFGIDHGAKVMGATVIPMSSGNTARQLKIMEDFQSDILTCTPSYAMYLAESLEKEGYTADDISLHGGIFGAEMWTEEMRRSLEEKLGITAHNIYGLTELMGPGVAAECKYQTGLHIQEDHFYPEIIDPETEEILEDGKRGELVLTNLTREGMPVIRFRTKDMTALRRDECPCGRTTVRMDRITGRSDDMLKIKGVMVYPSQIETAILQIEGLTANYQIHVSRPHTLDEIEVKVETSPEVFSDEMKKIEEFERRIAKKIQSAIGISVDVTLVEPESLPRSEGKAIRVIDERNFD

SEQ ID NO: 7256 - protein, 143 aa, Methanobrevibacter ruminantium
MSVKQLSVFLENKEGKLKKAVNAMSQAGVNIRALSIADSSKYGILRLIVSDNELAIKALKEENFTVKETEVIVVGVKDEPNGLNTMLEILEKEHINVEYLYAFVSSKTDEAIVVVKIGNYEDGLKALENANANLLSKEDLAEL

SEQ ID NO: 7257 - protein, 92 aa, Methanobrevibacter ruminantium
MPFKIDSAIVKKDMDSGKYDLVDPEGKFSQADALMVINSDDFITVQLIINAILRNDFKAWKDVKWEGGDSLKSLLVKLGYGKEEIVEMLKEF

SEQ ID NO: 7258 - protein, 1058 aa, Methanobrevibacter ruminantium
MPVDKDINKVLIIGSGPIQIGQAAEFDYSGSQACKSLREEGLETVLVNSNPATIQTDMDMADTVYTEPLTAELVAQIIEKENIDAILPTMGGQTGLNIATELGKLGLLEGIKVIGSDVQTIADVEDRDLFANFMDRLDEPIPKCHAVESVEGALEAVEEIGYPVIVRPAFTLGGTGGGIAHNKEELIEVTTHGLDMSYINQVLIDESVLGWKEIEFEVMRDKNDTCIIVCNMENVDPMGIHTGDSIVVAPIQNLNDEVCQRLRDASIKIIRNLGINGGCNIQFALNPETNEYKIIEVNPRVSRSSALASKATGYPIAKISSKVALGLTLDEIQNDITKETPASFEPSIDYIVVKIPRWPFDKFKGIDRKIGVQMKATGEVMAIGRTYEEAIQKAIRSLDIGLHGFEYLEYTEDNLANPTDERLFHMYSAIKDGRSVEELAELSKMDAFFLYKIENIVEFENQVTKEALEDEEFLLKAKKLGFSNFTLAKLAGIEEEDVKALLDKFDIKPSYKMVDTCAAEFEAKTPYYYSSYDKGNELVKSDNRKILIIGAGPIRIGQGIEFDYCCVHSSLALKDQGIETILVNNNPETVSTDYDVSDDLFFEPLTYEDIMGIIEQVEPEGVIVQFGGQTSINLSVPLAKAGVKILGTPYESIDRVEDRERFTEVLNDLHIHQAPYGLANSFDEAKEAAERIGFPVLVRPSYVIGGRAMEIVYGVDELEEYMKEAVKVSPEHPILVDKFLEDAVELDVDLLCDGEDVFIAGIMEHIEEAGVHSGDSACVIPPQTIPEHLLEVIRENTRKLALELDVIGLMNIQYAVKLDEERVYIIEANPRASRTVPFVSKAIGVPLAKVATSLMMGKTLKDFNLTKEIKINHVAVKESVFPFLKLTESDSVLGPEMKSTGESIGIDENFGLAFYKSQLSAGMDLPKEGNLFISVREQDQPKIQPIAEKAHALGFNIMATKGTANSIFDVPITRVKKVSQGQPNIKEAILDGKVDMIINTPHGEQASKDGYTIRRLAVELGIPYVTTLAGARAALNAIAAVKENDLKVKSLNEHIANI

SEQ ID NO: 7259 - protein, 359 aa, Methanobrevibacter ruminantium
MGNEAKLALEDGTVLKGKAFGYETTTVGELAFSTGMSGYTESLTDPSFKGQILMSTYPLEGNYGVSEDWYQSDSVHVEGFVVREACKKLSNFGTKKTLDDFLKEFKVSGIEDIDTRDLTLKIREKGSLKAALATEEIDDDELVAKAREHTSITELDLVPLVSTPEIKAFGDFDKTVAIIDCGVKRNIIKCFLENNIGVALFPYDTDYQTILDYGVDGLMVSSGPGNPERLTSTIENVEKLLNRFPVFGICMGQQVIAKAFGATTYKMKFGHRGANQPVKDLNTGKVFITSQNHGFCIDPESLAGSDLELNQINLNDGTPEGFLHKELPLRTIQYHPESGPGPNDTKVLFEEFGQMIREY

SEQ ID NO: 7260 - protein, 249 aa, Methanobrevibacter ruminantium
MSHFDNSDFNKDLDVNNQYDPVKGNDKAFNGKYSLNFSISHNDPNFSNLAMSSSIISETTLEEDCILLKKKSLLKRKSLGSQKIYYREILELDLIKSTLSSLYSSIRIVYSKNGYSKRVLSLSSSDGFAVRWFYDALVVKYSYVKSGLDKKYDFNSNESDWIEANESNKNTSLSGDLTNSNDLNDSSIKEDDLNNSNGSNSGDESHNSLSSKQSKLSDFVSQMNKELSEEETRSLKKKMKFERCSSGEY

SEQ ID NO: 7261 - protein, 76 aa, Methanobrevibacter ruminantium
MNQFCPKCGAKLLDPYAKFCSQCGTNLTEKKEINIDELPEERIDLREGMTNTNKGMYRYTKWGRRKKKPVNWDMEK

SEQ ID NO: 7262 - protein, 116 aa, Methanobrevibacter ruminantium
MRSLEEIGAKIEELNDKIAGIRAEDEENLTNELKVILAGSELQSIILTSTLTSKEQQVRDLLDKFVQRGDELNERYEEASIEDDAAAKNQLHAMIWTNDIRIDTLKWVLEEEDVGI

SEQ ID NO: 7263 - protein, 309 aa, Methanobrevibacter ruminantium
MTSQTSEKENQELIDSLNNEIDYLKEILTSKIFEEEHLLNFTCRDIETDYALKFGVYKYKIKGYKLKIKKTKRTIELIKKMVNRQEINLFNKKLEEMQPNQAKINETKINKPRLNMKEIEDHIENEFKEEDIELETETARTNILIEEHRNNLDRRVPVREIDALYKECIRKMHPDLLFNPTEYEESLFFNAKEAYEDRDFEELEATYNLIHTHKIEETPQTVEEMERFIEHLEIHIKLEEREISNIINSKPYTQQKFLLNQKKVNDYREGLVKSLLEVEKEYIKCKRELTDLKSKNNLSYKLDLTKKDN

SEQ ID NO: 7264 - protein, 148 aa, Methanobrevibacter ruminantium
MLIREFLPSDLARVYQIEVESFSTPYDIPILKQLYDIGAGFLVATENGQVVAYIIFWLKEENLGHIIALAVDRKFRGQHIATRLLMMAVTVLRNCSVPKITLEVKAQNTPAISFYEKFGFKIERKVPNYYEDGSDAYVMYFYTDSIKN

SEQ ID NO: 7265 - protein, 137 aa, Methanobrevibacter ruminantium
MWDDLEEYIENLSNDYSSKNNRKTKIVEIGVGKFQTISDHLRENENIELIMTDIDPANENVVKDDVFNPNMDIYKGADIIFSIRPPGEIQEAIMKIRDEIDCTLIIKPLFNEDLNIKAKGMKLKNYNRASFYIYQKE

SEQ ID NO: 7266 - protein, 102 aa, Methanobrevibacter ruminantium
MNQARIKLTGTDPEKLNYVCDQLKKISERTGVDISGPIPLPTKKLVVPTRKSPDGEGKATWEKWELRIHKRLVGIGADERAMRQVMKVNVPDNVSIEIELKN

SEQ ID NO: 7267 - protein, 413 aa, Methanobrevibacter ruminantium
MAKEKEHLNLAFIGHVDHGKSTLVGHLLLKAGAIAEQQLDEGEDKFRFVMDKLGEERERGVTIDLAHQKFSTNKYDYTVVDCPGHRDFVKNMITGASQADAAVLVVAANDGVMPQTKEHMFLSMTLGIKQLIIAINKMDMVDYSEDRYNEVKDEVSDLLRSIGRDPASTPFIPMSAFEGDNIKELSGNMSWYKGDALMTALDKLVPPEKPVDLPLRIPIQDVYSITGVGTVPVGRVETGIMKQGDNVIFEPAGVSGEVKSIEMHHETFPEAEPGDNIGFNVRGVGKNDIRRGDVAGHTADAPTVAKEFTAQVVVLQHPGVITVGYTPVFHCHTSQTACTFLDLTSKLDPATGQPEATKPDFIKTGDAAIVQIKPTKPMVMEEAANIPPMGRFAIRDMGQTVAAGLCLKVTDKK

SEQ ID NO: 7268 - protein, 735 aa, Methanobrevibacter ruminantium
MVMILSRRDKMIAKIKELMYQPKNIRNIGICAHIDHGKTTLSDNLLAGAGMISEELAGDQRFLDFDEQEQARGITIDAANVSMVHEYHGDEYLINLIDTPGHVDFGGDVTRAMRAVDGAVVVVCAVEGIMPQTETVLRQALREKVKPVLFINKVDRLINEVKLGPEELANKFIGIINEANKLITKMAPKDKKDEWLVKVDDGSVAFGSAYHNWAINIPMMQETGINFKDIIDYCNDENQKELAKKVPLADVLLGMVVEHLPSPEVSQQYRCPNIWDGDIESEAGQTMINTSPDGPLAVMVTNVSVDKHAGEVATGRVYGGTVEQGSEVYLVGGQARSRVQQVGVFFGPERVPTEKVPAGNIVYITGAKGATAGETICSPENKIVEFEGIEHISEPVVTVAVEAKNTKDLPKLIEVLRQTAKEDPTIHVNINEETGEHLVSGMGELHLEVIGVRINNKGVDILTSEPIVVYRETVAGKTPNPVEGKSPNKHNRLYLEVSPLDDSIFEALQNGDIKEGKIKAKEEAQQFIDHGLDKEEARRVWDVYNKSLFINMTRGIQYLDEIKELVIEGFESALEEGPVANEIAMGMKFTLVDAKLHEDAVHRGPAQILPAIRNAIKGGMMMADPTLLEPVQKVFINTPTDYMGSVTKEILNRRGQIIDMPTEGDMVNVEAKVPVAEMFGFAGEIRSATQGRCLWSTENSGFERLPRELQGQIVREIRQRKGLAPEPFGPDHYLG

SEQ ID NO: 7269 - protein, 186 aa, Methanobrevibacter ruminantium
MAKLFNKWDLDEVEVEDLGLKRYICLDETIVPHTLGRHVKRQFAKSNVSIVERLMNKIMRTERNSGKKNKAYNIVKEALEIINRRTKQNPVQVLVKAIENTSPREETTRIKYGGIGYQVAVDISPQRRVDLSLGFLTRGTLQSAFKNKRSVAECLASEIIFASEEDTRSFALQKKEEKERVAKAAH

SEQ ID NO: 7270 - protein, 141 aa, Methanobrevibacter ruminantium
MPGLFAAKKLKKNRQNFKWKDVDYKRRALRLDVKADPLEGAPQARGIVIEKVGVEAKQPNSAIRKCIRVQLIKNGKQITAFAPGDGAIGFIDEHDEVMIEGIGGPSGRSMGDIPGVRWKVSKVNNVALSEMVSGKIDKPVR

SEQ ID NO: 7271 - protein, 134 aa, Methanobrevibacter ruminantium
MRFIALFESMTGAMVKDCIIDDENSKVTFVVKNGDMGLAIAKGGTTVTKVKKAVGRGVEIIEYNEDPEQFIKNILSPAELKSIKIVTKNNDEKIAFVNTDSSNKRIAIGKGGINIERAKLLAKRQHNISNIVLK

SEQ ID NO: 7272 - protein, 99 aa, Methanobrevibacter ruminantium
MMDVERGIRVAVDTGDVTLGSEKSIQSLKLGKGKLAVVAANSPKEILEDVEYYANLSEIPFIVYEGTSVDLGSVCGKPFTVATLIINDPGDSTILEAMG

SEQ ID NO: 7273 - protein, 414 aa, Methanobrevibacter ruminantium
MAKYDISMIKDNNYYKEQCEHAEESLNKKWYSESILTMAITLEELTEELIKYTKNISDGKLSQRDKIWILKDNGITNYNIYNYLREANISRNKLVHGEIPRNYSNTFSMYKNFLKIVFWYDENYVIGKLNTKSKLKQYLNKVCDDSHILNIIEQEINDGAITENHQIIKRHNKELIDYVESLNIELEIKEKLIKDIYSGVTKNRSQIEEKIKREKKDPIIGVVNIVNTENMMKYTIQSTDIDKEVKENMEKLENNTHENKQLQEDYNKYGPESFTTETVNICKNEELSKITKEDEIIFNANKSYNNRKKDINPKIGIANIINTETLMKYTIQSTDLDKEIEENIGKLENNTHENKQLQEDYNKYGPESFTIETVNICKNEELSKILKEDEIIFNANKSYNNNKKEETGEKNHTL

SEQ ID NO: 7274 - protein, 584 aa, Methanobrevibacter ruminantium
MLGGINLNNEDIIIGIDFGTTNSAACIYKDEKFQIIPSAMGYDYFPSVVAVNENGELLVGHHAKKQMASNASNSVAEFKLKMGENETIKFNGEDKLPQEITSYVLGRIKRDAEAYLGKPINKAVISVPASFDNDARNATMEAGEIAGFEVEALVDEPTAACLTYSLTKNFLGNILVFDMGGGTLDIIIGAFDGSELVPKVTTGARFGGRNITMALRDYLQRDFEEQNGLKLEDYITPEYDPLIDLYNATEIAKIELSSTKTTNVHIDSIVMTDKGQRINLDKNVNRSDLNKLSDEVVKGSKEKVLEALKDAKLTKDDIDFLVFVGGPTKMPLIRESIEKLLGKSAAEGIDPMVCVAQGASIYKGGPITVGTINSLTLSVVINEKESDPLIPKNTPLPAEVTKEYHTMRDNQTSANIQIVEGESILAKENHTLHSFTLRGLPPRPKGEVAIQVKLKVDKNGIMGLSAKELSTNKKLSATFDSSNRMSSEEIKKAGLDNENLLSDYEEKIKQRNIINDAEEVIFEGKKLIENYSGHMLISDKNRVNENIEKLEGLLVIPKNFELIKLITKDLRNLIEKIESEDFYY

SEQ ID NO: 7275 - protein, 683 aa, Methanobrevibacter ruminantium
MVNKGSNDDFNCNNWELGRIFARKGNFTEADIRFEAELNHSLSPNSLVLDDHGHLLNRMGKYQDAIDKFRNLLNSDENYVSSLFGIGISYIGLNKLGDALKYFEKVNELDEEHADAWYYSAIIYGNPFYPKYDLNVAKIRYKNYQKSKESYINDPKYFSKPFDNLSWEELHDYYKCNSLFRIIEQSLDKGILDEFLNFSNDYKRLYCFDEEGLDKQFDIFRLFENDTPLADKIDKFHEDKNIEDKFESAGFEEDLIEGLSFKLGMMSIDDKKMLNELMDYSKSSQLSFNDINDLIRENVLDEDMSLDDFYENREYIVKNRIKKNNSEYERNVEKRVNTELKNQIAINKRLNDNLIEKDEVIEKLNDNLIEKDEVIEKLNENLNDKEEVNQKIEDKLRNNYELLSDENINQPEHRFDNYDFSTKEIKSSFSGLKESMDSYLEDMESYLNECQDVSSMNILSGINNQCYQDDLEYIKNECGISDVDLKTLKSAFKDFYNGKFGSASYNFSLERLRKTIGKTSELKKYRYFLKLTSKSREKILEEEDFNWLIIKNLKLKDYKNEKEKKINKGKKLKKEKYPIGWFNLGNICFDYANSQSVKTTVKAGNNAMDAYELAYFCYKCAEDSISNQEENSKYEFNFKDTKNEQEFKNNVVRMISNCEIKILQQEIKGELKKLDKLQGKFNW

SEQ ID NO: 7276 - protein, 545 aa, Methanobrevibacter ruminantium
MVDAEAKLDAIKKVEKVLKKNKIDFPQSYIDELASAYIRRDLTDKELNTLVLKVEEAYERAHIEAGEAVGTVAAQSVGEPGTQMTMRTFHYAGVAELNVTLGLPRLIEIVDARKKISTPTMDIYFEDEYKNDEEFVRKLANQIGKSTINDILADYDIDYFNYKIVTVLDNEKIESRRLDIDDIISRVQKTFKKLEIINYGDDELIEEEAKDIEDVDSDVEETDIAKVDKVDETGMAKADSDAEETGMAKADSEEDSETIQVSDEEVQEPSNINLKKSDENITLIFEPSKRTIRELRLLGDKVRDLQISGTKGIGKVIIRKDDAEWVLHTEGSNLGAIFKIEGIDKVRSTTNDIHEIEVVLGIEAARNAIVYELNRTLSDQGLTVDIRHIMLVADMMTSEGTVKSIGRHGISGEKSSVLARAAFEETGKHLLHASIRGEVDDLTGIIENIIIGQPIPLGTGSVSVTMKPDAYPITAGITKRGKGKSGGSASESKEVNSGIAKGGKGKSGGSASESKEVNSGIAKGGKGKSGGSASESKEVNSGITP

SEQ ID NO: 7277 - protein, 926 aa, Methanobrevibacter ruminantium
MSPDQIREMSVVNITRPDTYDEDGYPIENGLMDSRLGVIDPSLKCRTCGEKGGECQGHFGMIDLARPVIHVGFGDDIHKILRSTCNECGRVLLDEEEIEEYTEKLNELQEAGESTEDLIKEVYKICKAKKAKDVCPHCGAEQEDIKIVKPIGIIEVRKEYDENGELLTDANGNPVTTDYDLTASEVREKLERIPDEDAYVLGVNPEVARPEWMVLTVLPVPPVTVRPSITLDTGERSEDDLTHKLVDILRINQRLIENMDAGAPQLIVEDLWQLLQYHVTTYFDNEASGVPPARHRSGRPLKTLAQRLKGKEGRFRSNLSGKRVNFSARTVISPDPNISINEVGVPEMIAKEVTVPTYVNEWNIEDLREAILNGPDAHPGANYVRKYNDRIKDYNKVRVLDSNKETVAEMLTCGDIVMRHLKDGDIVLFNRQPSLHRMSMMAHEVRVLPYKTFRLNLCVCPPYNADFDGDEMNMHVFQTDESRAEAKSLMRVQEHILSPRFGGPIIGAIHDHISGAYLLTRDGFTVPEDDAFQMIRKSHLLKCPYDEYLKRDLDEKEYKQQIKEYNEKLKRKHRDWTGKELFSLLLPSTLNMNYRAEICRKCEECMAEACEYDSYVVIKDGQLTHGAIDEAAYGSFSGKILDNIVKEYGPAYAKEFLDRSTDLAICGIMKTGITTSTNDEEIPEEAIEVIDAHLDNAEQKVDKLIETYEMGELQPLPGRSAEETLEMRIVQVLGEARDAAGDIAAGYLTMGKQSPDDSYDHVMAVENHSVVMAKTGARASMLNLAQITACVGQQSVRGGRITRGYLARPLPHFRKHELGARAKGFVHSSYKEGLDPVEFFFHAMGGREGLVDTAIRTAQSGYMQRRLVNALEDLNVRSDGLVTDNKNQVIQTVFGEDGIDPAKSDFGKVANLDKLIDEMRIKDEGK

SEQ ID NO: 7278 - protein, 603 aa, Methanobrevibacter ruminantium
MVKAKIYINGKLTGTCDEPEEFVKEMRARRRSGEIHNEMNITYYDENHEIYIFTDPGRARRPLILVEKGEPLLKDEHIEAITKGELKWDNLFELGLLEYLDAEEEENSYIAMNLSQLNEDHTHLEIDPSTMLGICAGIIPFSDHNSSPRNTMEAGMTKQALGLYVSNYALRTDTRGHLLHHPQTPLVKTRIIDAINYDDRPSGQNLVVALMSYEGYNMEDAMILNKSSLERGMGRSSFFRSYEASERRYPGGQEDKFERPEKGVKGYRSEEAYKNLDEDGIVNPESHVESGDVLIGKTSPPRFLGEIDEFGTVAEKRRETSVTVRHGEKGIVDAVLLTETVEGSKLTKIRVRDTRQPEFGDKFASRHGQKGVVGLILSQDDIPFTEDGVVPDIIVNPHAIPSRMSVGQVLEMVAGKAGCMEGHRMDGTPFNDNVEGEIKRALHDNGFESAGCESLYNGVTGERIEAEIFVGVAYYQKLHHMTTDKVYARSTGPVQVLTRQPTEGRAREGGLRFGEMERDCLIAHGAALALKERLLDESDKYEAVVCNECGMLAVYDKNKNKMYCPICGDSETYPVEISYAFKLLLDELKSLCIFPKLILGDKA

SEQ ID NO: 7279 - protein, 520 aa, Methanobrevibacter ruminantium
MNNETWGLVDSFFDKYDIVDHHIKSYNDFVENRIQNIIDITEPITIENEKGNYTLRTGKLTIEKPFTKEADGSKSMIYPTEARLRNLNYSAHMYLEMALHDNNSDEEEELENVYIGELPLMLKSSICHLHGLSDEELVKRGEDPKDPGGYFIVNGSERAVVTMEEIAPNKIILERIDEIEDRHAKAIVTSIKSGFRARITLEYKKPRKSGVFLRISFPYVPGEIPLVILLRALGLSTDGEIISKISDDFNFQMYIADDLQVSEKDLKLDSDLLLSLSNEERDEYLQKAAIKYIGNRVAKGMTEEYRIKRAEDVIDRYLLPHMGIESDKRYDKAIYLAEMTEMLLQVIEGQREPHDKDHYTNKRLRVSGDLTEDLFRVAFSSLTRDMSYRLERSLSRGKELSIKQAVRSDVLTENIKHAIATGNWVGGRAGVSQLLDRVSYMATLSHLRRVVSPLTRSQPHFEARDLHPTQFGKICPNETPEGPNCGLVKNLALMCKISEGFDPEDIVNIISTMDNVDMID

SEQ ID NO: 7280 - protein, 82 aa, Methanobrevibacter ruminantium
MKFDILEHNAVPKHEILTKSEIKKIFSKLDYDVSQLPKIKIDDPVSKAIGAKEGDVLKITRESQTAGTFITYRLVDGFTANK

SEQ ID NO: 7281 - protein, 304 aa, Methanobrevibacter ruminantium
MTNEIIKENTEKIEEILNGIEEAMENVKAKSPLTHCITNFVTINDCANAALAIGGSPIMTNDSQEVAEIGNIASAIVINIGQVSQLQINSIKKSCEHANKTNTPIVFDPVGAGVSNIRNTITKEMVEFYELTAIRGNMSEIKAIVNLIDLEIKDNEKKDSAGKGVDVAESDIITRDNLYTNGLIVRELAKELETVVMASGPIDIISDGEYTFALENGDAMMPLITGSGCMLSTIIGTYIGANEPLIGAITASALMAIAGENAAEAVKKDNLGPGSFRNFLIDNLYKVTADDISKRANLFEIDLN

SEQ ID NO: 7282 - protein, 219 aa, Methanobrevibacter ruminantium
MFKAMKKEDKMNKSSIDYSVYLVTDHRGKTDEEILNIIEQAIKGGTSVVQIREKTASTKDFYNLALKAKEITEKYNVPLIVNDRIDIALAVKSDGVHIGQDDMPAKVAREIIGEEMILGVSASTVEEAMKAESDGADYIGSGAVFPTATKDDADSVSKEELKEIVNSTSIPVVAIGGITIENAESLKDAEIDGFSVVSAIMNADDPKKASEILKEIYNR

SEQ ID NO: 7283 - protein, 410 aa, Methanobrevibacter ruminantium
MAKFNTIDDFDVNGKTVLMRIDINSPVDPNSGIILDDTRMKIHAETIKELSLKGAKTVLLAHQSRPGKNDFTTFKQHAEVLSKAVGMDVKYVDSIFSSTAKEAILALEPGQILLLENVRFYSEEQLKRSPEEEATSVLVKSLSPLIDYFINDAFAAAHRSQTSLVGFTTVVPSAAGRVMEKELTVIGNALENVQHPCVFALGGMKADDSIMVTENVLENGTADYVLVSGLVANIFIWAAGYDIKSTNENFIEARGYLDMVDKCRDLIKRFPGKIIYPQDVAVSVLGDRADVTIENIPDASIFDIGRQSLIEYSKIIREAKTIFANGPAGVFEDPKFAIGTEDIINAIASSEGFSIIGGGHIAAACVNLGYGDKMDHISSGGGASINMLAGKPLAAVQALEASAELFNNKE

SEQ ID NO: 7284 - protein, 224 aa, Methanobrevibacter ruminantium
MSLKTPVVILNFKTYLESSGQKALDLANALESAGEESGITMVAVPQAIDIYRIKEETSIPVLAQHIDAVSPGGHTGSNLFESFVANGVDGTLLNHSECRMTLADIAEVVQKTKGADLISCVCTNNIETSMAAATLAPDFVAVEPPELIGTGIPVSKADPEVVEGSVSKVKAINKDVQVLCGAGISTGEDMAAAIDLGAEGVLLASGIIKAENPKDALLDLVSKI

SEQ ID NO: 7285 - protein, 304 aa, Methanobrevibacter ruminantium
MTFTKEEQAKLEYSGYRFVGEHGHAAAKTCHWTRKSIKNEGVCYKEQFYGVKSHRCLQMSPAVPFCHQKCSFCWRDLSQTRTEWEGEYDDPKTIIEGAIKAQNNLLCGFGGNKKADRKKLEESKRPTNAAISLAGEPTLYPEIDELIGEFHRQDFTTFLVSNGMYWEKLGSLENEPTQLYVSLDAPNEKVYNELCNPQIDDGWGKLNKTLELMPSFKNNTAIRITSVKGKNMFNTDEYAELINKADPTYVEVKAYMFVGSSRKRLSMDNMPRFHEVNDFAKEIADKTGRELTKYSEASRVVLLE

SEQ ID NO: 7286 - protein, 374 aa, Methanobrevibacter ruminantium
MKFFEHSAKKVFESEGIKILEGHVVYSPEEAMEVATEFGRPIVLKSQVLVGGRGKAGGIKFADNPGEALEIANELLKLEIKGEKVKHLLIEEKANIKKEFFLSVSNDRANRRPIIMASAEGGVEIEELAKTSPEKIIRYNVNPLKEFLPYEAREIARKMGVGSELISPLGSIIWKLYNVYDKYDAEVAEINPLILTDDGLIAADAKLEIENDALFRHQDLVKQNRFKQKDFAFVKLDGDIAVIGNGAGLTLTGMDMVTLFGGKPATFLDIGGGASEETINKALSLVLNYPPVKVVFLNVLGGITRADDVARGVIAALEANKWDVNIVIRLTGTNEEEGQRLFDEAGIPYEISLEEAAKKAVEMCNEIKAKEAGK

SEQ ID NO: 7287 - protein, 193 aa, Methanobrevibacter ruminantium
MFGKFKVKKYFSELNKAYYSNDFKKAIKYADIILEMDKNNLEVLKYKYNSLANMGDYENALVCIDEIITLEKSCMALLNKGTTLCYMNRIEEGFKLLDYVIDNCEEYEAAFINKCNFFFMLEEFDEALSLSDKILNMHPDCSNAYDTKSFIYYKREEYDSSLIYANKALEKNPNNNIALERKERLLSILNSKD

SEQ ID NO: 7288 - protein, 287 aa, Methanobrevibacter ruminantium
MVEVKESPYKKYLREDRLPHIFCPGCGNGTVMSAFLKGLEGTDIDFENIAMVSGIGCSSRIPGYVKCDSLHTTHGRALSFATGLKVGNPDLDVVVFSGDGDCASIGGNHLIHAARRNINLTVICINNNIYGMTGGQISPTSPKGSFGTTAPYGSRDMPFNLAELVSAAGASYVARWTTTHPLQLSKAIQKGLENNGFSFIEVVSQCPTYFGRKNKLKTPLSMFQYIKENSVNKRRAEKMEEDELEGKIIVGEFANKPHDELTDSIKKLIEENSNMPLAIKSAFEELD

SEQ ID NO: 7289 - protein, 376 aa, Methanobrevibacter ruminantium
MAEERFVQGNEACALGAIAANCRFFAGYPITPSTEIAEQMSILLPKYGGAFVQMEDEIASVGAIIGASWSGLKAMTATSGPGISLMQENIGYGFITETPIVIINVQRGSPSTGQPTMSAQADMMQVRWGSHGDYEPIALAPSSVQEFFDFTIKAFNLAEEYRVPVTVLADEVVGHMREKLIIPDEIEIVKRTRPEKPDGQYLPFDAPMDGTTPMPAFGDGFNIHVTGLTHDERGYPDTNDPESHTKLVERLCNKVIMNRKDICSVKKEQCDDADIVIVSCGSPYRSVGAAMKKAREEGIKVGSLKIDTPWPFPEEEIAEIAKTASDIIVPEMNLGQMVHEVERAAKGEANVHLIGKIGGILHKPEEILAKIKEISG

SEQ ID NO: 7290 - protein, 68 aa, Methanobrevibacter ruminantium
MIIIDSKLCKGCDICIATCPKKVYSKSDKVNTKNVYLPFPEHEEGCTKCGLCELSCPDQAIYVEKEVE

SEQ ID NO: 7291 - protein, 42 aa, Methanobrevibacter ruminantium
MDLNDLNKNNLKQKKNHQVLKDLKINNLIIIFLDLTQYINNN

SEQ ID NO: 7292 - protein, 123 aa, Methanobrevibacter ruminantium
MGAKEKYFSNISNRERAIFEGAISMGALFHQFVGTPFNRKTAESLEKAMEESFTLQPCIDKVEVSIDLDRLDKAMTEFEYTSLSGDMLDVKIYSKVDDVLAVIRIEFIEELNYPLMYVEDIIE

SEQ ID NO: 7293 - protein, 283 aa, Methanobrevibacter ruminantium
MIEERIQILRRAAQISTEDREEKVWCVIAGNDRLVDDIAYNAITRQGQSPDYPLGENVSITSKHSYKKFDCIMLKGETLKIRELKNKTHEEGGASLQITTTSLERQPNLLVVIGPEESMKRFVGQTSRQEVKIDILLEDHTTGFIKSEPKSTKIPKFLKNFFNPIIESSEVILSVLLISVKDEGDIDKVKGISQENSLFGIDLKSTIQDKEIARLKERKAREKAKKEEAEKKEKEEKEKAKKESEKKEKEEKEKAKKEESKEDKKEIEKGETKEDKKEEDKKD

SEQ ID NO: 7294 - protein, 356 aa, Methanobrevibacter ruminantium
MSIFGNEDAIEIEPTRVVKNSLGIDLGTLNTVIAKPSGDKFDLYQIPSVVAVKRDDPTAVLAVGEEAKKMLGRTPEDIIAVRPLKKGVIENIAQAQALLIRAMEIGINEGETVERIVIGIPGDSSEVEKNAAEEIGRKAGAEYVLVISEGLAAAIGAGLPIAEPMGTMVLDIGAGSTDIVVISLGGINDIETVRCGGDDIDNRIVELIEEKYNVAISIHDAEAAKIEVGMVHCSEEFENLNYEVIGKSLETNRPKKVVIDSMLVADAAEPIIKQVIGGLNLILERLPAELMMGIYNNTVAVGGSSRLRGIKERIFDESEIPIKISDDPMTVVAKGTAIVAAEPLALEPEVRLKAMK

SEQ ID NO: 7295 - protein, 79 aa, Methanobrevibacter ruminantium
MDMKTIYLSEEVYNRLSLLALESENYNDLIARLIDVYENSYFDELSDAEADFYNERIKYFENGDYEGIRKVDLKFFGKN

SEQ ID NO: 7296 - protein, 219 aa, Methanobrevibacter ruminantium
MNTLGLDEAGRGPVLGPMVVAGIVIPEKKEKIIERMGVKDSKRITPKRRAVLYRKLTRMFDYETVEISAKDIDLLRAKGVNLNQIEKLAMMRIIAKLKADTIIIDSLDIKEGRLEEEMQNFVGEGSKVIAEHKADDKYIVVGAASIIAKTKRDEIINQINKEYIRSTGNKDGIGSGYPSDPKTKNFLKNYKYDEMPDFVRRSWGTVQRIKEAEEAEKSL

SEQ ID NO: 7297 - protein, 205 aa, Methanobrevibacter ruminantium
MYLGRIISAGKTEDGKPFVAYRVSSRSFPNRQVKVLEDEAAIIPKEGFEKDIFKNSYIAYDCIKTVGDIAIISNGSQTNPIADKISIGMNIRDAMAYSLITLDYEKDDYNTPRIAAVVKGGDDFEAYIGIVTDSKILVEKIDEGAQFISTYEKNSPEDVVYSAETPDDACKFIFDEGAFAEFENPVCSVAAIFDGKWNISGLNPE

SEQ ID NO: 7298 - protein, 254 aa, Methanobrevibacter ruminantium
MTLELFGLKKIPLVKKGDDIAKIIEDDLKEEDIQLENGDILLIAETLISKAEGNIIKMDDVEVSDKAIEIAEKCKKDPKIVETILQESNEIVAVGPNFIVTETKHGFVCANSGIDESNVEDGLATPMPENPDKSAKEIREYLEEKYQKEIAIIITDTQGRAFRVGAIGTAIGCSGINPLWVRIGDTDLYGRALETTEVATADELAAAASLLMGQADEGIPIVLIRGFDAFNILRDTETGIKPLLRPKEFDVFRK

SEQ ID NO: 7299 - protein, 169 aa, Methanobrevibacter ruminantium
MVEINYSCTNCDFSFLDKNLIFYLDTANETERIDNLEEILNDKTDNLELIETSLNKESSDKMTKALIAGFLYENYCPHCKQLIKTYVPEDNKLFTDQEMEKILKKEISKNKQENNNFKILFFDFKNTLYRDRRKILESNECPNCNKEMSLVISEKTPCPECGEKLKEDF

SEQ ID NO: 7300 - protein, 301 aa, Methanobrevibacter ruminantium
MITILSGGTGTPKLIQGIKEIYPEEEISVIVNTVENEYFSGGYVAADCDTVMYTFADMIDDQFFYGIIGDTFKIRNILIEMGTTELLKIGDMDRAIKIQKTILLEEGKTLSEIVEHQKNKLGVKAKIIPMSDEDSEIKIITKEHGELDFHDFLIKHQCEGEVLEVKYSDVKPSPNVIGTIKDADKVIIGPSNPITSIRPIIAIEGVEEALKEKKVIAVSPFLGEAAFSGPAAKFMNAFGYEASSKGVAELYKPFLDTFIIDNEDKDKKEELEKIIPNIVVANTFMKTIEDKINLAKVVLEL

SEQ ID NO: 7301 - protein, 253 aa, Methanobrevibacter ruminantium
MIQMTLIQIDNYGPWTVTPRPRTESDLQILQAELFADVQRQIAAKKGLVFFTRFDNLLAVTNGLNEEDHMRIQRSIRNRYPITISMGVGAAETAHEAQRLATIALQKEGGAQSSGRKEILAINNLIENPEDSFVQAAHIDINSVTETLTDIESAFDTSFMVNKAQHYLMTKLREKGALLFFIGGDNFMSPCNGLSEEDLTNILKEIDEEIGIGLKAGIGRADNMEDAAYMADIGLEIIREGNNKEWIHVIEEL

SEQ ID NO: 7302 - protein, 237 aa, Methanobrevibacter ruminantium
MAGITNAEFAMKLIPYGFDTVTIGGYNTDSESIDACEKIIARGRKEFNYPKEEIYSVIENEVNAIKDSFNVQVSANLRGSTPDPLIKISKIEKLDIIEINCHCRQEELVAVGCGQSMLLRPDLEDYIREVVKKSESKVSMKMRANVEGVDNLEIAKLAEDCGVDYLHIDAMKMGVRDADFYLIKEIAENTNIFIIGNNSINSISQAEKMLNAGANGISIARAAISGKLNFDLNQIKI

SEQ ID NO: 7303 - protein, 326 aa, Methanobrevibacter ruminantium
MAGTMKAWRINELGKPPVLEDVPIPEPGFGEILIKMKGAGMCRTDLEVIDEGFITVPFVGPFTFGHENAGTVAKLGPGVDTVEVGQNVIVDTLHACGKCQYCLSGRDNFCEVASARGLKEDGGMAEYMIADAREVAPLGDLDPTEYVALADAGLSPYGAVQTAKPFIPNNGTAVVIGVGGLGFYCCQYLALTTSARVIVVNRSADKMAKMTNFGADELVVLDDNAYDKIMELTDGKGVDAVFDFVGRDNTLELAAQITKGLGLISILGLGGGTLPVSWTTVKPGVMVRLTQGGTITDLYEIMDLAKAGKITVQAQKYPFSKVFRSS

SEQ ID NO: 7304 - protein, 85 aa, Methanobrevibacter ruminantium
MSKLSKLPNIGKVLEKQLNDVGIKTDEDLIDLGSKEAWLKIKEVDDSACLNRLMALEGAIQNIRWHNLSQEDKDNLREFYNSQKI

SEQ ID NO: 7305 - protein, 219 aa, Methanobrevibacter ruminantium
MVRPKIERRIVKKPSYTCIQHGDISREEDFESIKMNLDEFEAIRLGDYHNIKQKEAAELMGISQPTFHRIINSARKKTAMSLIEGRKIEINNENFYSEDKIYICNNCGFQWNNPKKEYANCPDCKSENIERIKVNLNESDYINNNPNKIKTNSQICDIDNTDVPLNERKSFGGPGSGRGPSKACECPNCGHIAPKIKGFPCRNIKCPECGTPLCGSKHK

SEQ ID NO: 7306 - protein, 536 aa, Methanobrevibacter ruminantium
MSFITLKNINKSFNGEPVLKDINLTIEEGSTLGILGRSGSGKSVLINMLRGTKEYAPDSGQVLFDLAICENKKCLHVEPASKAGGKCPECGAELQAKQIDFWNAGRLEKAAIRRRISIMLQRNFALYDEQTVIDNVLNAMGDEGRYEEENIYNAIDLLEMVQMSHRVTHVARDLSGGEKQRVVLARQLAKNPMLLLADEPTGTLDPQTAEKLHQTLIEGVKDEGISMVITSHWPEVMNHLADDAIWLDNGEIIEHGAPDTIVENFLKTVPKAEQVEKIEHTEEIIKVQDIKKHYYSIERGVVKAVDGVSLTINQGEIYGIVGLSGSGKTTLTKMMIGLTEPSAGELVIRLGDDWIDMKKPGPLNRGRVTPYLGLLHQEYSLYPHRDVLGNLTDAISLNLPAEFAKIKAAHILETVGFEKDKSMSMLTKWPDELSGGERHRVALAQVLIKEPNIVVLDEPTGTMDPVTRIIVTNSILKARDELDQTFVIISHDMDFVLDVCDKASLMRGGKLLSTGTPEEIVAELTGEEKADMIKDH

SEQ ID NO: 7307 - protein, 160 aa, Methanobrevibacter ruminantium
MAWDDAPSHICRGGDVRGLAFCCPPVKPCPVMNALREVGITPQEFLEIKQKFARETRLGEGPATCFGSLVWCCKTSKPCPLRDMTLNQIKMTEDEYMTLKKQLSEEILKAGKPKDNSAEAMALAETFNISVEEAKKTLEDCDNDLRMAVKLLKLKELDNE

SEQ ID NO: 7308 - protein, 207 aa, Methanobrevibacter ruminantium
MGLTSLFLEVENKNVFILGTGEVATRRAHRFLDKGANVILAGNSIDEELSKKGAILTPIKDLEELVKWSDIIVTASGDDELCEYIASISQGKLINRADKPEKGNIIAPTSFLIDDIEISIYTNGQSPLMARELRKKIQSIITEEDILEIKLQDYARKLLKEKVEDQKTRKQYLLKILNNTQIKQCLKEKNLDKAKGLAEEIINSEFN

SEQ ID NO: 7309 - protein, 398 aa, Methanobrevibacter ruminantium
MIINIRVDHTLADIETMEKVSKDLKELFSNLKENFNISEYIEINTCNRYEYFLYTNVDDDSLDCDNEYVIIEYDDSAILHLFRMTSGLESMIIGEDQILGQIKDSKKKSEKEGHCGKTLDTIFTKAIHVGQVVRNKTKINQGSISIGSAAVDLAEEHLGDLQDKHVLVIGAGKMGTLVAKALAEKNLKAIFVANRTYYKAVKLAEELDGEAILFDNLEEKLLNADLVISSTGSPHPIVNKERLMKVFGDEVPEKMIFIDIANPRDIEDDVKELGIDLFNIDDLRGIAEKNKKLREKEVIAAEKIIENEFNLLKESFNLIEINSILGSLRESMEEIRQRESQKGIVKLNAVDARDIKVIDKMTKSIVNKIFYDISEKVKISAKNNEEDVIKMCEAILKR

SEQ ID NO: 7310 - protein, 375 aa, Methanobrevibacter ruminantium
MKSDNKSSKIKKSEVYIKSSSDSIDKEAEELILESAGYPFNFALLEGPHLEISDNVLFEQYAIEQWSGTLVKTGSYLFDQKIIPDYAFKVLKVFPENSIISENTSIVVADVDKDKRSSIKSKQYDVHFDDIVGQENAKSKSKLIYKYLQNPDKFGTWAPKNVLFYGAPGTGKTMLAKALANELDIRLYLVKSTSLIGEHVGDAASRIHELFEAASRNAPSLIFIDEIDAIALHRSFQSLRGDVAEIVNSLLTEMDGISPNDGVVTIAATNNPSAIDFAIRSRFEEEIEFKLPSDDERREIIMLNLDTFPLDYDLDIEKLVKVSKRMSGRDIKEKLLKTALHNAIINDKQTVDMDDVAFALGVNKYKEEEVKGMFE

SEQ ID NO: 7311 - protein, 278 aa, Methanobrevibacter ruminantium
MKDKVIFGPAGKPIDFKGKAFESPEYLGPRGLYAFEYQSTYGVRIGESSAIKLRESAERNGVLMSMHCPYYINVCSKEEEKIDSSIERLIQSAKVGEYMGAYRLVFHPGFYSNRKADVCMDLAKETYRRLLLRCEEEGIEDFTFAPETTGKRSQLGNIDEIIEMCASFDHFEPTIDFAHVHARGRGILNKKDDYNCIFSKLEDNLDIDRLHCHFTTIEYSHKGERKHHTLAEGDEYGPHIKDLLLNLIENDWKATIICETPLIDQDALRMKKLYDSLI

SEQ ID NO: 7312 - protein, 338 aa, Methanobrevibacter ruminantium
MKSVAINGFGTIGKRVADAVAAQDDMKVIGVSKTRPNFEARTAVEEKGYPLYIGIPEREPLFKEAGIEIAGTVEDMIQEADIVVDCTPGNIGPQNLEMYKKAGVKAIYQGGEDHELTGLSFNSFANYDDSYGADYARVVSCNTTGLTRTLHTLNPLVDIKKVRAVMVRRGSDPSEIKKGPINAIVPNPPKVPSHHGPDVQTVMKGIDVTTMALLVPTTLMHQHNLMVEIGNDVTKEEVIEALEKRSRVMVVEAAAGLDSTAALMEYAKDLGRSRNDLYEIPVWKESINVVDNELFYMQAVHQESDVVPENVDAIRAMLEMESDNEKSIAKTNKAMGIF

SEQ ID NO: 7313 - protein, 183 aa, Methanobrevibacter ruminantium
MVFMIDLDQLKKEINDLTKDYKGFEFKYIDTDSIVVEPWTRLKCQYGCPNYGKTLVCPPFTPKAEEFIGMVNSYKTAILFQISLASLEDDIGGITKVSVDIENLCAHFGYYKAFGMGAGPCMVCKSKGEECSLDACKYPNEARPSGEACGVDIHKTIENNGYDILGIDEENNSYFCYGIVLLE

SEQ ID NO: 7314 - protein, 361 aa, Methanobrevibacter ruminantium
MANTFFSKIVKSLWVLASFIPTLNGLGFAYIGAKEFKNNWIIEGVIYEIPWFLLFIFVNNEDLGVFFATIGLLGMAVSFVRSLYVYYKHKDILIDDDAESRISTEKSITSFWVIFSVIIFLNGLGLIYVGFKRNVRQWILEGAFFEFLWLLFFITPSNKALNSFIISLGFIGMILSVIRTFMVYFEEERMDGGFYSPTAVKKEPPAQNPIENTINSYSENNLSDDDIVPEFKGYKTQVEDLKDAFKTKEDNVNNLLSKRFTKEELSYGRFKSVVNEFHKTFYSQADSTLTMINLAPEYSERVDETIKNKIGLMDSLLGEMNNLLEELILNDGLPEKSDEEITELFENMHNLINSVDDYNKE

SEQ ID NO: 7315 - protein, 550 aa, Methanobrevibacter ruminantium
MENNDLENLRKLIQDILDFAKTHSDTLDEDSAPLWYFAKGKFNITLDALLLNDILCFLSFLGLSDGNISSDELNFINYVLNFNFTKSDLELYLKNNLIDDYSESLPPSFFVFYEFDKFALENGKLTESIVDSLFEVFNGIGHLFIALDNESSLEKNILDSFLDNIKKQLADLRGFQYELMVLALKNDLIDNMLDTNSIDGFSDSNLDTSFDSDLDNPQLDDSFLDKVDDFFFNNESDDDFVSSVDSSNDDLNMGGDDSLDSDSQSNSSSPSDSDSQKDNKKSIQESLDKLNKLVGLEAVKSDVNSLINLIQIRKLREQRGIKQPDMSLHLVFSGNPGTGKTTVARLLSDIYCQLGLLSKGHLVETDRSGLVAGYVGQTAIKTQEVIQEAMGGILFIDEAYALSSAKGENDFGQEAIDTILKAMEDNRDDFIVIVAGYPDLMDEFLHSNPGLESRFNKHLYFEDYNPQELFDIFVSMASETNLKLDEKAEEFLKGHFEDVYNSRDDNFANGRYVRNIYEKVLSNQANRLVGMEDISDDDLNTLTLEDFKDF

SEQ ID NO: 7316 - protein, 86 aa, Methanobrevibacter ruminantium
MDSENLHRRLKKIIGQLNAIDRMIDEDIPCENILMQINASKSALHRVGYIIVEGHLDNCIKNAMEKGDTDEALADISSILEYYSRL

SEQ ID NO: 7317 - protein, 149 aa, Methanobrevibacter ruminantium
MSSEKRNSKDQSYLGFELIEVEDYYLLSNTEKLLETVKKDWFKSLMDEIRELVGKHYPDFVIYLAYVDHGDDGTILGYVNVREDDNKRDEEYSEVALNKEMLEICEKHKEDKILFVTIPRKRKSFIKLKKGSIREHFKEALLKLGAKPL

SEQ ID NO: 7318 - protein, 362 aa, Methanobrevibacter ruminantium
MTGESTHEHTHKEQRRQYTFNKLKAFGQEIIEDIEKNKVPTLKIPSRGTGNIVYDEDKRYYILGDRYGRRSLGNVKQIRKLGQMVYVANFCKDLVQRDKTATIREMYYISEGWGIEFNTQQESNIVGEDLEVALGATREDLGLMPEEDGASVYGDITLLDGDYEINAARAGKSGYTISPTIDQVELLDCGADFLLAVETMGMFHRLVQEKAHERYNCLIVGLKGQAARATRRFIKRVNEELGLPVYICNDGDPWGFHIAQVIISGSAKLAHVNHDLATPDAKFIGVTASDIQNYDLPTDPLKDIDVLRLKELSKDPRYQTDFWQTEIKKMLKLGKKAEQQSFSKYGLEYVVDTYFPEKLGLN

SEQ ID NO: 7319 - protein, 599 aa, Methanobrevibacter ruminantium
MSQQAQELFENFNELTPSEFFRKNKQMLGFSGKIRSLTIVFHELITNSFDAAEEAGILPEISIKLDRLGKDHYVLTHSDNGPGIPEEFVMKVYCQMFAGSKFRNIQSRGQQGLGCSGCVLLSQMTTGESTHVTSGWMENGELKGVKMEFKMDVKQNKGDLIKKSEFTPTGTGVCIKLHFKEVSYSLAEQGAFEYIRRTMIANPHAKITFRDPSAHKYIFKRAAEIVPVLPQEVLPHPKGVTADDIITIAKFTDKRNFKSMLTSSLSRMSSKKVSELQELTGIDMKKRPKNMEWAEAEKIVEAFGKMKFMAPPTSGLIPIGEEQIEKGMKLILKPEFITTITRSPVTYKGGVAFIVEAGIAYGGDAGRIVNEQRKSEILRFANRVPLTFDAGSCAITEALRSIDWRRYGLRDLDNTPLTLFVNIISTQVPYLSTGKQSIAPEPEIVHEIRQATMKIARRLQKHIRSKKAEKEKAMRSKIFEDYVPVIIEEAASLAETEVPDYKPVLAKVTRRALAEIMGEKVEEEEEEEDFVDSLLEELDEFGHTVDKEHSARKDRIQESDLDEAFIDDEKPRKRSKKSKKSEGADEGQSTLFDSEEQEE

SEQ ID NO: 7320 - protein, 203 aa, Methanobrevibacter ruminantium
MNELPETDYLRVPSDRIGALIGTKGETKHLIENATNTHLDIDSDDCTVAIYPGENMEDPLGVWKANHIVKAIARGFNPHVALKLNKDDTYLEIIKLPLYVGKSKKAMARYKGRIIGKDGKTREIIVDMAEVDMAIYGKTVSLIGELDNVMVAKEAVEMILNGSRHKSVYAFLENKKNERKMKEFKEVVGIEKDEIEFRDDLDD

SEQ ID NO: 7321 - protein, 77 aa, Methanobrevibacter ruminantium
MSLLDNIDKIHTTEMGVGRIQRNLGIDVDPVEYCILKIKDKDAVIEEKGKNYYVTVDDCIITVNKHSFTIITAHKKK

SEQ ID NO: 7322 - protein, 259 aa, Methanobrevibacter ruminantium
MDDENPRVAKADAEVQKLISRKRTKDADDRKVSSEIFDKATLQVLYKLANQGHLDVLNGAISTGKEANVLKGIKEDGSIVAVKIYRIATSDFKKMQYYIAGDPRFNVRSSNKRQLINNWVNKEFRNLTRLKDAGVNVPEAITSLNNVLIIEFIGDEDGNPAPTVKNLPPQDPAHFYEQLVEQMDRFINKANLIHGDLSSYNILNFDEKPVIIDVSQSVVRDHIIANELLARDIKNISFEFSKMGVDTSIEDLTNRLIKD

SEQ ID NO: 7323 - protein, 106 aa, Methanobrevibacter ruminantium
MFRRQILAKPQNNQQEYRRVRTPKKGEIPGVVEQIMGHGKLKVRCADGNIRMTRIPGKVKKRIWIREGDVVLVKPWDFQSDQKADVIWRYTRTESNWLERKGYLKM

SEQ ID NO: 7324 - protein, 404 aa, Methanobrevibacter ruminantium
MGVEFLNIIESDEAKEIIKEKFEECYTAQSEIIDIAESANRITYSKIESKIDFPPFNRSLKDGFAIKAEDSYGVNEENPKKLKVIDFLEAGSFTDKTVELGSCVEISTGAPIPDGADAVIMVEFSYKSDENPELEDDEVEILTSVTPSQDIGQKGSDVKKGQVILDENILLNPPKIGVIAAQGIDTVEVYKKPKVGIISTGNELLTNQEELRPGKIYDVNSEMIRAGVNACGAEGECLGIVRDNYDDLKNKITESLKECDILLCSGGTSAGVGDNIRHILDELGTVYIHGITVQPGKPTILGVVDGKIIIGLPGNPVSAIVIFNVFVAPAIKKLAGFKQEEEQKTIKGKLAKRIHSPIGRMQYQLVKVEGDSVIPIFKDSGAIFSLASAAGYTKKSQKQNPNLV

SEQ ID NO: 7325 - protein, 155 aa, Methanobrevibacter ruminantium
MEIQEKTIEDQKVAIMNYKGYLKDMEILISKLTGWIELEEIETVGDLFAIFYNNPRTAKEDEVVYDVGIPINPELDPDETEEIRIVTIIEHKVLSGLHYGSIDNIQETYNIMAEYSIENKYDIIGSPKEVYIKSKFDVEDEEDMITEIQLPVIKM

SEQ ID NO: 7326 - protein, 102 aa, Methanobrevibacter ruminantium
MAEEEKSSKKKSKRELEKELNSKVDKIIEKNFEDFKSQDELEDFIQKAFDDKASQYNKKIELKEKELDKKFKASRENDNKKIDRKIREMDRKLKLRYKTMLK

SEQ ID NO: 7327 - protein, 437 aa, Methanobrevibacter ruminantium
MIYEIAEEAKREISKYSDTYEIYIDRTELLELDSQKTELNFAKEDLSLGVGIRIIKDGAIGFAFTSDMDEIAKTCENAYLNSKLNTKDEFYSFAEYEKLPVVKGTYDKRFKDLDLDELTGSLKSVLNSVEDYGCQVSSGGFSAAEGETLIINSNGVEAYDNSTGFAIGVSINAVKDGELTTAYDSDSSCLYDLDGMALVEDICNLAMDSLGGEDIETSDRDVVLDYHAATGLLSTFLSGFNADNVQRGRSRIADKMDEKIITENLSIYDDSTIDGGLNSSRCDDEGTASKRTCLVEDGVLKGFLYDIYTANKDGVKSSSNGFRSSYLGTPSVGASNLLFDFKSHRNLDDIDDAFLVTDVLGAHTANPITGDFSVEASNSFLVSNGDKKPIKKAMISGNIYDLLADAEAVGTETKQRGSFIIPKIFLPNVRVVGNNSN

SEQ ID NO: 7328 - protein, 234 aa, Methanobrevibacter ruminantium
MVKIEAIAVDVDGTITDGRRRVCHSALDALRKAEDAGIPVIIATGNISHFSYAVATLVGTTGGLVCENGGVIYHDGYNDNRVIVLGDISKAQKAYDFLFDKFGKDIPFRIVEDSDARVSEITFYKNMSSEPLKEMLKDFDVEVYDSGFALHLTDPAVDKGTGLAKLANLVGYNVENIMCIGDSENDIDFLLAGGFKVAVANACDELKEIADYVCENKYGDGVAEAIDKFVFNQE

SEQ ID NO: 7329 - protein, 317 aa, Methanobrevibacter ruminantium
MMASMKEMADAILKRINDLAVPVKIMHVCGSHEHTIMEHGIRSLLPPEIEIVAGPGCPVCVVPSREIDECLQLVEKGVTVTTFGDMLRVPGSNGSLAEAKAEGADVRVVYGIPNAVEIAEKIDNDVVFMSAGFETTAPATASELLKKPPENFSIISCHRLIPPALDFLINSGETNLNALIQPGHVCTILGTEPFEKFSTEYGIPQAVAGFNPLDILMSVYMILRQIDRGEPRIDNEYKRAVRTEGNVIGKEMMDEVFHVESREWRGFPKIPDSVLEVNDEFSQWNAREKYDIEVKDVTEAPKGCICGPILRGLAKPY

SEQ ID NO: 7330 - protein, 480 aa, Methanobrevibacter ruminantium
MSEYVRFIQRIGLVGITNILISLSSLIFIPIITKSFTTAEYGMWAQVNTTIALVPNIANLGLPYTMVRFLSAEKDKEKIRDSFYPMISLTFISTVIICLLFLIFGHPIADALFNGSMQVLYITTAISFFACMNLMLITYFRTFQEMKRYSLFLVLQSYIGVFVSIYLTYAGYNIETVVLGLLTGYAAVFIMMAFLIVRHLGFSFGKWSNLKEQLAFALPTIPSNVSSWVVDSSDKYVIGILLGSVAVGCYSPGYALGSILLMFLSPFAVLLPTILPEHYEKGDMAEVDKYLSYSMKYYLLLTVPAAVGMSVLSKPLLYIITTPEIALGGYMVTPFVCLGAIFMGMYGITNNILILEKNTMILGKLWIIVAISNIVLNLILVPYLNIIGAAIATLLCYMLAFGVTAIASRKTMRLPFNRKELVKILIASAIMGAVVYMMNPSGIVNVLVAILVGVVVYFAIIFVLKAVTRKEIGIFKDLVK

SEQ ID NO: 7331 - protein, 168 aa, Methanobrevibacter ruminantium
MISKIFNIKQSIKRAYYTYRVKRVSKSCGDNLTVNNYSYVTPKTSLADNVNFNGMKIQGTANVSIGSNFHSGIDCMIITDSHNYEGEAIPYDETVISKDVVIEDNVWIGNRVIILPGVCIGEGAIIQAGSVVVKDIPKCAIAGGHPAKVFSSRDKEHYEKLKEEGKFH

SEQ ID NO: 7332 - protein, 456 aa, Methanobrevibacter ruminantium
MKKVILIAFYFNQVNEIASKRLRALAKYLPQFGWEVVVIVPDLGYEPSSNADLSSRIITTEYEDMFSHIFTKFKPGDKSKLNDKSDNHSTSDSQKLKDSSSVSNPIASKAISIAGEVFAYPDGMKYWYGPAYEAASKIVEEEKIDAIISSSWPITCHTIAKDISDKYNIPWIADLRDLWNMDPYISHTFIRDYFEKRLELKTFENTDVLTTTTDLAAKTLATLHPNNRIVPILSGYDEDDFKFLESVLEENNDSDSSEDSVSAGDSNSSEGSVSAENSNSSEDSITTVDSTDRKLKLIYAGSLYGGKRDPTLLFKAIRQLEDESKLDSSNISIEFYGDSGNLEEIAREYSLLDIIKIGGRISHEEVLKKQLDSDVLLLISWNNEKEKMFIPGKIYEYFALQKPVLSIGYKEGSLKDLIEDTNVGYHVSDLESTKKVILDIYNEFISLGKVEFKIRN

SEQ ID NO: 7333 - protein, 364 aa, Methanobrevibacter ruminantium
MSKIKIAIVGIGNCASSLIQGIYYYKDKNPEDAIGLMHWKIGEWDPTDIEVVAAFDIDKRKVGKTIDEAIFAKPNCTTVFQEEIPKSDVKVCMGPVLDGVSEHMADFEEDYTFVVADEEPVDVVEVLKESGAEILLSYLPVGSEEAARFYAQCALDANIAYINCMPVFIVSDPEWDAKFREKGIPIVGDDIKAQIGATITHRTLSNLFKERGVKLDHTYQINTGGNTDFMNMLNRKRLDSKKESKTEAVQAVLAERMDPHDIHIGPSDYVPWQKDNKVCFLRMEGRTFGDVPMEIELRLSVEDSPNSAGCVIDAIRCCKLGLERGIGGQLTSISSYVMKHPPEQFTDDEAAAKVEAFIKGEIER

SEQ ID NO: 7334 - protein, 573 aa, Methanobrevibacter ruminantium
MKVKITETAFRDAHQSLLATRMRTRDMVPIAEEMDKVGYHAIEAWGGATFDTCIRFLNEDPWERLRILKENFTNTPLQMLLRGQNLLGYKHYADDIVTKFVEKSYENGVDIFRIFDAMNDIRNMEQSIKVAKAQGAHVQGTISYTISPVHTVDKFVEFAKELEALECDSIAIKDMAGLISPAVVFELVSRLKEETDLLVNLHSHCTSGITPISYYAACQAGVDILDTAISPLAWGTSQPPTESIVASLQGTEYDTGLDLKTLNQIKKYFETLRAKYEGYIDPISERIDTDVLMYQIPGGMLSNLISQLKQQNALDRYQDVLEEMPRVREDMGYPPLVTPTSQIVGIQAVMNVINGERYKIVSNEVKDYMKGYYGRAPAPINEEIAKKIIGDEERITCRPADLIEPEYDKFKKEAEDLKNFEKEEDVLTLAMLPPVAKQFLNGEIKEEDFPEKKVIDDGGISAIPTEYSVEVDGDVFDVKIMPTGYIKIDGEGSEPAPVIEGAITASMQGMVLKIKVNTGDKVQKGSVVAVLEAMKMENDIYAEEDGIVEQIFVEEGDTVNAGDNIMVIKGLDE

SEQ ID NO: 7335 - protein, 201 aa, Methanobrevibacter ruminantium
MDKRINFVSISRFTLLVAIFLLIINKIQFHAKILDYMALALAIFAIICIIIFIIQFKKGLVEFPIKVVVETNVDKALADGAITEEQAENIPKRVVLNANDIFLNLVFNLAIANHFDLLPVDVLREYIPDIPPANLMRLYEKSREISDDLNDYFRSQKFLNKADVITRSDEIKTYLRETYPWMDDVTLDNTFDYFFLGIGNG

SEQ ID NO: 7336 - protein, 424 aa, Methanobrevibacter ruminantium
MVFIIDPQNAGISGNMIIGALVDLGADGEKVKNLMEDVAYDFGEVEVSITKVNKSGIEANFCNVKTIHDEDENNHHIHFPDFIDKIDSLKELDIENLTDEILDMAKNVFKRIAISESRVHGKSLEEVHFHEVGAADAVADVLGAICAYFDLDMDKERVVGLPISVGGGTVKTAHGIIPVPAPASLDILKGLNEDEFNDFYKGEAQCRGGPVESELATPTGCALYMEFCDEFLEFAPMMSPERIAYGCGSKEFDFPNVIRVIKSKDTNEKHRVCVIETNIDHMSGEELGFLFDLLLDAGASDVSMVPIVMKKNRPGQLIKVISKPLLVDHLVNILFKQTGTLGIRVSENTHRGIAERHFVPLDININDRIYTINFKIGLIGDEIISHRPEYEDLKRISLEEDIPLTEIKEVANTMIRDFLENNRE

SEQ ID NO: 7337 - protein, 278 aa, Methanobrevibacter ruminantium
MKEKNNDDYFEKQNPSILRSIGGLFTFSTILPLNIYTTIDEMAKMTWFWPVLNGIVGLIAAIIAFILCRFAHLDGLVIGAIIYGFLLIINGYNHFDGLMDFGDGVMVHGDPEKKLRIMKDPMTGVGGIATGFIVGTITIALYSSLIDYSYMISPDFILLIIVAEIAAKIGLTTCCITSKAGKEGIGKYFIKYMNIKNYIVGLIICLIIASLLSMRIGSQIGILGIIGGAFGGALTALIAKRHLKIANGDVLGTSNELGRLFSLLAMLIAISMHFSVLI

SEQ ID NO: 7338 - protein, 185 aa, Methanobrevibacter ruminantium
MTINVLRLDHRIGRDTRITTHVCLTARAFGASKVWLAGEEDHSMMRSVRDIADRWGGDFEIEYNNSYMEVIMNWREKGGKIVHLTMYGAQAHEVVDEVRESSDDILIIVGGAKVPTKVYKNADWNVSVTTQPHSEVAALAIFQHLLMEGKEFDLEFKDPVFEVIPTAHGKTVNVHNENRKLNKKE

SEQ ID NO: 7339 - protein, 373 aa, Methanobrevibacter ruminantium
MQRRGTTNLPLHGGHTPRWLFDRMTKLSGAITEVVIDEYGPNEFLNRISNPYWFQAFSCVLGFDWHSSGTTTTTLGALKSSIDPEKHGIYISGGKGSASRKTPQGIVRAGEIFNLKSSHVDNMVNSSKLSAKVDNSCIQDGYTLYVHNFFITEKGDWAVVQQGMNTETKYARRYHWMGENVDSFLQDPHNGISCDKKEKEALNMASKDSVEAQKISVDLINDNPNHLRDYFKRKDSNQLLLTDFSISQENTLTLPPHHQVLDMDLSDKEFQVLKNAWEIQPENYEELILLNGIGPKKIRALALISDLVFGEPASWKDPVKYTFSHGGKDGFPYPVDRDVYDNSIATVKDALYQAKLDKYDKMKALKRLDDFIS

SEQ ID NO: 7340 - protein, 166 aa, Methanobrevibacter ruminantium
MKRITTPISDDDINDLKIGDKISLSGKMYCGRDAVLPKLSKSIENGQEDKYPFDFKGMAIMHTAFSVAGIAPTTSNKAEIESSMEALSSAGVKFHIGKGSLSDETKKTLDKYNSIFIVTPPVAALLTNNVISKKCVAYEEEGMEAFFELEVKDIPGIVAIAHGKSL

SEQ ID NO: 7341 - protein, 388 aa, Methanobrevibacter ruminantium
MNKEPISEEEIFKELDFYQSQDCKYSDGRILGSMCTQAHPIAQKAFIQFLESNLGDPGLFKGTKAIEDKVLKMIGSFLSIENPVGHIVTGGTEANIMAIRAARNIARDEKGISQGEIIVPQSAHFSFKKASDILNLKLREIVLDDSYQLDASFVEDEINENTVAIVGVAGTTELGMIDPIEELSNIALENNIHLHVDAAFGGFSIPFLKEIGYGLPEFDFSLKGVKSITVDPHKMGLAPIPAGGILFRNEEYLDSISVNSPYLTIKHQSTIVGTRMGATSAATFAVMKYLGKDGYARLAKESLDNAIFLAESVKQLGYELVVEPKLNIVAFNHPKLETDDLAQLIEKRDWKVSCSSCPKAIRVILMNHIKREHIVELISDLKDISESI

SEQ ID NO: 7342 - protein, 756 aa, Methanobrevibacter ruminantium
MYVIKFEDLGKDDIGIAGGKGANLGELTQAGIPVPPGFVVTSETYKKFMMDTGIFNSVMDILDQTDINNTKELQEAAEEIKRIVIETPIPEDISTYIIEAYNQLSQKVGVDEADVAIRSSATAEDLPEASFAGQQDTFLHVQGIDNVIEYVRKCWASLFEARAIFYREENNFEHSQVYIAVVVQQMVDSEKAGVMFTVNPSTGENIALIEGSWGLGESVVSGTVTPDNYVVSKENNELLNITVSDKKTMFTNDENGTSIQVDVPEDKRNERVLSDEELEKLVEMAKRVEGHYGKPQDTEWAFHGGNLFLLQSRPITTLGDAEEKASEEDVDLEVLIKGLGASPGLASGTVKVILSLDELDKVQEGDVMVTTMTTPDMVPAMKRANGIVTDEGGVTCHAAIISRELGIPCVVGTGDATTTLKENDKVTADGKKGLVYKGIIKGEEPAEAAAVQVSATPLITVTEVKANVSMAEAAPKAAATGADGVGLLRTEHMMLSTGVHPRKFILDGEEDKLVDVIAEGVLKVADEFYPKPVWYRTLDAPTDEFITLEGGEDEPREHNPMLGWRGIRRELDEPEILKAEFKAIKKLHDKGYTNIGIMIPLSQHPSELRRAKEICREVGLEPQVDVEFGMMVEIPAAAILIDEYIAEGIDFVSLGTNDLTQYTLAVDRNNEFVAKHYREEHPAVMALIERTIKHCAAAGVTCSICGQAGSVPHIVEKLVKFGITSVSSNTDAVEEVRKTVARAEKKIMLDAARKQL

SEQ ID NO: 7343 - protein, 160 aa, Methanobrevibacter ruminantium
MVRAYSRREYIRKIPNNRIVQYDMGNLSEDFPVRLSLAVKKPAQIRHNALEAARIASNRYMQRSAGRLGYHLKLRVYPHNIVRENPMATGAGADRVQSGMRNAFGKAISVEALVKTNQKVMSIDVNPKNFEDAKVALKRAGMKLPVSCKIVVEKGAELIK

SEQ ID NO: 7344 - protein, 78 aa, Methanobrevibacter ruminantium
MKIKSNIRLKYNNSKNAEIVYKSLEVDNEGFLESELNSDEIEYNIKSDKLGSFLNTADDLIASEILIEDPFKKQPKKD

SEQ ID NO: 7345 - protein, 256 aa, Methanobrevibacter ruminantium
MAIQDGDFVRVDFTGSIKETDEIFDTTSEDIAEEAGILVENKKYGPIPIIVGGNHLLPAIEEAIIGSEAGESVHVSVTPENGFGQRNPNLIQLIPMKEFKKQGMTPVRGMKISTENGNGKIISVNGGRVKVDFNHDLAGKNLEYDVTVVELIEDDEEKIKSMIELHYSYPNMDYDNIEIKFDGSTVSIKLDEITRFDQQSYMDVTFARFRISKDIWDNMDYEKVQFVDEFEKIVEEAPDEEVEAEVETEVEADAEE

SEQ ID NO: 7346 - protein, 395 aa, Methanobrevibacter ruminantium
MPSIDFIRNILKEDKKTFCNDYKKAQKSLSDDDGYSNGSSQSKQSYEKTNEESTSNPLIADFTEYSPLHNGHFHCMKTAKSKIPNGLFVAIVPGLFERSGRGLPYIMHRNVRAEIAIEVGADIVVEGPPMGIMGSGQYSLCLCKMFQALNTDFIPRGYRPFDGYDEILKRISMGHGVAPKPYKIVDMDTKETILEGKLEEDNYVIVSFSKSLKRIGFDFKDKFIFVPRIEGVSGTLIRKACSENKLEDVESMLPPETLRILKRELDNDNAPLHDQRDYEVILNSANNLSYDELIKLNFFSEKLANEFIEKRENKEFESISEIEDAIFYGFSSHYKNRVLSILETQMRGDVISNYINTYPFNVRVLNYKNETVLTQFEEKVLNDHPFVNSIELTNE

SEQ ID NO: 7347 - protein, 65 aa, Methanobrevibacter ruminantium
MSEETKIKRVTIHVESELDYEFRRLASQKFRFEPKWYSKAIKEAILLWIENNPEEDFEDLPEEDT

SEQ ID NO: 7348 - protein, 417 aa, Methanobrevibacter ruminantium
MFDLVLKNLKLVGESGEFYIAIQDGKIAKMSKTPISADNEMDIKGQYVLPGLIDPHVHFRDPGLTYKEDFKTGSMAAANGGFTFVMDMPNTLPKTNTYKAFKDKLEMANSKSVVNFGLHSGHSSFEEMERILELNPMSFKVFMDLESDERLREIFKNISNLDGNPILTVHAEKQSIVRENTERLSEDLELKDKPISYSYARSAESEIESISQTISLSKEFGNNLHICHLSTKKGMELAKENNISYEFTPHHLLFDNSYFDKFGTIVKTNPPLRESKDKVNVSDIDSDSMIGTDHAPHSLEEKNKGVWDSSPGIPSLETVLSLLLTEVNKSNLDFNLIPKIFAENPAKRFNLKNKGFIKENYDADFVVVDLNKEGTFNIDEFYTKAEYSPFDGMDYQGAATMTIIGGEVIMEDNELFI

SEQ ID NO: 7349 - protein, 410 aa, Methanobrevibacter ruminantium
MIVFNEDSCIKCGACEGVCPTAAIEVGDHIVYCDTCSEEPKCAEVCTKGALQVDDIAIDEEGNTQVRLIFNKTKCDECGDCVDACPSKTLKLDPEDSQLLKGFCVMCQKCVDICPVDVIGVPGIKEPASRVIEPEGAVYIDDCKGCGVCVAECPVDAITLSAYGEPIEVDEDKCIQCGVCSQSCPWNAIFIAGNAKPAKRSKVMKSFTLDADACIGCNSCVDACPGDFISPKSDLTVALPEACAACGLCVNVCPVDAIDLDVEYGASKFDSTEGICWDGEKCLYDGGCALKCPTEAIRVVTKRGMEVPSRQKDMGEQSFIMCVRCGACANVCPNDALQLDYVDKEIDGETVMRDRIIFNPSKCDECGECIDACPYDMLHKAYKVNLPIAGFCTLCEQCLAKCTPEALSLK

SEQ ID NO: 7350 - protein, 470 aa, Methanobrevibacter ruminantium
MEPVTRIEGHAKITVHLDEAGNVEDTRLHVMEFRGFEKFLQGRPAEEVPRIVPRICGICDVQHHLAAAKAVDQIYGFNDDDILPAAYKMRELMNWGSYMHSHALHFYFLAAPDLVVPNGTRKTRNVFQIIQDMPEVALQAIKIRRNGLDIVSATGGRPIHPTSSTPGGISTELDEETQADLLAKAKENVELAQATIELAVPILEEKIDLVKTLGYFGDTRHCGIVTKDGDWDVYNGKVRIKDKDGSIYTEYRNLEYKDIVAEHVKPYSWLKFPYIKELGYPEGIYRVAPLSRINVCDKMPDAAPLAQGALEDFRDRFGYAQYPLLFHWARLIELLASAEMAVDALEQDLSGDKFPDALERTAGEGAGIVEAARGTLIHHYTTDDEGLITQANIIVATIQNNPAMEMGIQQVAKDYIKPGVEVDDKIFNLMEMVIRAHDPCLSCATHTMDSQMRLATVEVYDSEGNLINKI

SEQ ID NO: 7351 - protein, 308 aa, Methanobrevibacter ruminantium
MADKAKVGTMWLGGCSGCHLSIADFHESLLDVLELAQFEFSPVLCDTKYDEVPELDVLIVEGGIRNEENRELAEMLREKAGLVIAYGTCAAYGGIPGLGNLHTVEELTTEGYINSCSTVNPEGIIPNEDVPTLESRVRPLGEAIQVDLLIPGCPPKSDVVAEAILTLLNGGTIELPTTNLCEVCPREKPPAGLAMDFIKRQFEIGKPEDDLCLIAQGLVCMGPATVSLCGAQCPSIAIPCRGCYGPTAKVNDAGAKMISAIASDYGVNEDKTVDPEQVADQLDDIVGTFYTYTLPAALVPAKMQKGGK

SEQ ID NO: 7352 - protein, 141 aa, Methanobrevibacter ruminantium
MSEDVKIVMFCCNWCSYGGADTAGTARMQYPPNIRVIRVMCSGRIDPQFILKAFRDGADGVFVAGCHMGDCHYDAGNYKLDRRMRLVYKLVEDMGIGRERVHHDWISASEGEKFASSVKMMVDRIKDLGPSPLKAQLDAEG

SEQ ID NO: 7353 - protein, 139 aa, Methanobrevibacter ruminantium
MSKYFLDANFIIAIFREIETNNELAISTCEELLSNHECYISNGVFNEIITILMMRTKDIELTVKAYYFMKDNLTIINEFEISMFNDRVFEMFKRYNSKSFKVGFTDCSIAFLYKYYGLDYIVTFDKNFKVFDDVNLLDL

SEQ ID NO: 7354 - protein, 81 aa, Methanobrevibacter ruminantium
MIDIIANTKMYKNKQTIIPSEVRDRFNVDEDTIIEWGVDEFGDLRITFRKKVTLKDVAGMIKKENDVEGDWKIDRGVYLNE

SEQ ID NO: 7355 - protein, 407 aa, Methanobrevibacter ruminantium
MANDALRAKDKKAALGTDIVIENFSKEEVNAFDVLDDIDDVDKKTKRTLLKVGVDTESEERAGSFLQMDQSNVFSSSISNSVEVMNTGIALEKYSWLKDYMWNAVKPDADKYTAQTALREVEEESYSGYFVRSLPGTKEVFPVQACMFIADQDVMQTAHNIIIAEENSELHLITGCATGEDVSSALHVGVSEMYLKPGSKITFTMVHNWAEQVEVRPRTAILQAENTTYINNYILTSPVNSIQSYPTTHCNGENARALFQSIQSGTKDSIIDVGSRALLNAPNTSAEIISRAVANDESSIYSRGHLAGNVPNVKGHLECHGLVLDDGSSIYAVPELEANAANLEMSHEAAVGQIDEEEIYYLTSRGLTEEEAASMIVRGFLSMDITGLPDELAAETQRMIDMSLDGM

SEQ ID NO: 7356 - protein, 252 aa, Methanobrevibacter ruminantium
MLLEVKDLVVEVEGKRVLNGVNLAIREGETHVLLGPNGAGKSTLFLTILGFPKYEVVEGSIIFNGEDITGLSTTERVQKGLGVSFQNPPAIRGVSVRDLLKFESKQDPDEDLNPRMQELAKKLKFSDEFLDRDVNRGFSGGEVKRSEILQLLAQEPLFTMFDEPDSGVDIENVELLAGELNVLLDKDKKPGQRKRAGLLITHLGYILNFVKADKAHVLMHGIIACSGDPDEILEDIRKEGFKGCVGCAECGK

SEQ ID NO: 7357 - protein, 89 aa, Methanobrevibacter ruminantium
MENAVAKPNPHRREEKLWSEIKNYQVATNNARILGVLDELIINEKTGKIVDIAVKIESGRNIHVKGAKRRGDLLLIPFTKLRKLENSLL

SEQ ID NO: 7358 - protein, 210 aa, Methanobrevibacter ruminantium
MIIALVMAGGKGLRLKSNIEKPLFPINDKPLMDYVLDNLKKSKYIEKTVVAVSPNGENTKSYLKDDLNFSDFHDDFYNSTKTDFYLDTKGIGFVEDLSEILTCFENHSKDDILLFINADLPLVDENIIDYIIEYYLDHDKPALSTLVPVEIFEEYGIPYTYDFNGKVPAGINILRSENVVQEEEVLIIPRYELVFNINTIETSILASKFL

SEQ ID NO: 7359 - protein, 492 aa, Methanobrevibacter ruminantium
MSFLDKIFNKGPKPIIAESQSRDLSILKAGNRPQGPGVMVAQQDEYYVTASVELGNTTTKCVIMATNLNNSQSYLINKTVNMTRDVRAPKPDEEVFGKTVWGIELSKESVADMIKDTVLESLKKAHVDMDEDLDFVVRSTGVTAGFATTQEVGQMVKALADGCLDAGISHTKMAPAMSSAHLPKRLQKYTLLDNVMFDGAVVSVVPPKGKEVVANEMEGELVTAGIKLGAKWTEVDYRNPCVSLDFGSTLAGRIVNKDEPYASTVGNFLGLAGVISDSLAKGSKQIDQKNGAALDLFDPKLLKKADGKKHQEKAKQYAKEAHELINICKVPEGIDRFGTVPLDAAGAKAAGTCLIGCDVGTNADGLDGLVEIGAKIYEDEGIPTLLATMDHVSANIVYRVLDVAFEENLILDGSILGVTGRAGITGKKPELILEYAQDKFKDVVFVEDGLALGSAIMARCMNSMGTQKNPLGGNQGERCILKKRMQAQGTIE

SEQ ID NO: 7360 - protein, 293 aa, Methanobrevibacter ruminantium
MGGQPGEYPTVLAGTIFYGGHKIISDEKAGDFDKDAAEGLIKTMEEMSDVTGNPCVVQTFGATAEAMVKYLEFVGDICDKPFLIDSTAAAAKIAGVEYVQEAGLAERAVYNSLSMAAEAGEIEAVANSDIDASILLGFNPMTPGVPGKLEIWETGGSVIDEGILEMAERCGITKPWMDVAVTPLGQGAGPAVRTSYAVKAKWGYPVGSGIHNVPSAWDWLRQYKKEHKEAWPVCDIGSNIVQQMAGGDFVLFGPIENSRLAFPACGMADIMIAEAARDIGTEPIEAHPLNLLL

SEQ ID NO: 7361 - protein, 272 aa, Methanobrevibacter ruminantium
MSAGGSGAPAEGAVNANVMLAVGIIGGLIGIYASSFEPTIGPVIACLGAVCAILWGVLAIRSVASYGLGTGVPSIGYMSLGIGVIGALAGVGIIAAFKLKGLEMLGPILALVFAMLIGLLVAIVAKKIVGMKIPVMERCTAEIAGAAALAVLGFSSAIAGGYSIDLLLTAVVAPGFIALFYILVTMAIQHPFNACLGPNEDQVRTLKCGASTAFLTMIITGILAISAGGYAWFAILVVGLIGWYVSFKMFVNASYEAAASVKWSGLWPKVEE

SEQ ID NO: 7362 - protein, 250 aa, Methanobrevibacter ruminantium
MAQYYPGTSQVAENRRKFTNPDVELEVLREISDEDVVKLLGHRAPGEEYKSVHPPLDELDEPDDIIREIVEPIDGAKAGDRVRYIQFVDSMYFAPAQPFLRARSYVYRYRGIDTGTLSGRQIIEARERDVERISKEILENEYFDTARTGIRGAGVHGHSLRLDENGLMFDMLRRQVLNKETGNVEMVKDQIGRELDEPVVLGEPLDEETLRAKTTIYRCDGEAYKDDEDAVTVLRQIHVTRSQFGYNPEY

SEQ ID NO: 7363 - protein, 416 aa, Methanobrevibacter ruminantium
MQVIADLGGTPGKDCRGYCKFCYFRKVKPLTEALGCQHCPPNKVGCERCLEGVQEAGKPFQQPFTVLSEVQMALMMNPVRDANLKVNISGGGDVSCYPQLEELIASLYQWQLPIHLGYTSGKGIDDGDIASRFLNYGVNEVTYTIFSVDPALRKQWMLDPTPEESLKAAQLFAEGADLHAAAVIIPGVNDGQALVDTCNKLEEWGAKALMMMRFANSYDQGLILGNEPVIEGVVPHEPLEFEELVKEINSEYDMRVTGTPLGDPTIGAPFIIAKDEYEEFLGILPEVRGEATLLTSKIAAPFLKKIFDKIAPDNVNVVATKKDIACLMTKQDLEALDLDELKDAVILPGRAFIHILDAERILSSDGKQRLVGFGPDTLSVDGELSSGMSEEEVIEHELGSFIELIEAINFFGMRRL

SEQ ID NO: 7364 - protein, 73 aa, Methanobrevibacter ruminantium
MKIRKRIKKLKRIKKLKRIKKLKRIKKLKRIKKLKRIKKLKRIKKLKRIKKLKRIKKLKRIKKLKRIKKLEKE

SEQ ID NO: 7365 - protein, 304 aa, Methanobrevibacter ruminantium
MYETLTFTGGIHKSEELKELIEDLGGFVLQSNILQMELVLNMAVPIDDVKIIEDKANELLGELSVAPMAGSEIAIVSPTLARHHLPHAACDISEYLRRYGAKDNMIGLARGHGKGTAGISETEKALIEEHDIAIFALGSFKQCIVDKAYLYNDIDIPVIVTGAPEIDLEELPGVDAYVPGLGRIPRRLKRGENIRALKHLVQTIEDLLEKRKKELAQDPPIVPSILVKNEIENQVPAIEGVFSPTPVTSQLSGLRVKLDYDNYHEEIENVVIGEQKLKDIANIKKSHFYDYILVELLTESSLVD

SEQ ID NO: 7366 - protein, 554 aa, Methanobrevibacter ruminantium
MGVNMYAENNILVGANENTEVYLLSKLANRHGLIAGATGTGKTVTLKTLAEAFSDMGVPVFLADMKGDVSGLAKIGEPSSKTTERMEKYNLADKGFIFKSYPVEFWDLYGEKGLPIRVTISEMGPQLLSKILNLTEAQEGVLNIVFRVADDENLLLIDIKDLKSMINHVSDNAELYESKYGAVAKKSATTLLRSLLALEEQGGDMFFGEPALELEDFMQCDDEGKGIINILDSVKLSTAPELYSTFLLWMISELYEKMPEVGDMDKPKFIFFFDEAHLLFDDMAPAVQKKIEQIVKLIRSKGVGLYFISQSPSDIPDSVLAQLGNRVQHALHAYTPKEQKAVKTAAETFRPNPAFDTKEVISNLGTGEALVSVLEEKGAPSVVEQVDILPPQSYIGAIEDNFRAELMSISPLRGKYKEAVDRESAYEMLLNKIDNNPNIQTEIPPEAPIRDIPNQAEQAPSQPQAQQAPQQAPSQPQAQQAPQEEAPKQKGLLDDVIGIAVGTAVDQMTKQNKTTRSRKTTKQTTVEKATSTMVNTAAREVTKGIIRGLFGNMK

SEQ ID NO: 7367 - protein, 122 aa, Methanobrevibacter ruminantium
MVELDREELYRQLEEMENDLRLYPIEEGLEDDIIDYINGKELSDNEKWDLENRLEDFFYGAKLKCRKPTYYFTDGFEFYVTEIYIDFRILEHVRKSFPKFNQLSVSSEIEQGFSTLSVKLTL

SEQ ID NO: 7368 - protein, 265 aa, Methanobrevibacter ruminantium
MKLNINKETCTGCKLCETVCIRDNIIVVDKKAVEVDNGDCFDCGHCLAICPSNSISLKGFDGQKDRVGEYNPKEIPVSSEDYLNLLKQRRSIRWFKKKKIDKETFNKLFEAAYYSPSAQNAQDVEFVVLDNELDEFMHLVYDIISAEEDKFFRIKQFGEYLRGEGDYKNHPLLWEGHQMILAFSRNSANALIASTRLELFAYTMGLGGFYSLFTLKADELDHDRLMEFFPGIDSHKHMYSAFVIGYPRVKYRRTVPHKGIDVYYR

SEQ ID NO: 7369 - protein, 179 aa, Methanobrevibacter ruminantium
MSIYDFEVKDINGNMVSLKEYEGQVLLIVNSATECGFTPQYNELTQIFDELNEEGFTILDFPCNQFGKQAPGTGEEIAEACRATFLVQYPIFEKIEVNGENEEPLYTYLKSEQPFVDITGEDAERLKGILESINPDYMDSNDIKWNFTKFLVDREGNVVARFEPTQSLDDVKAQIKELL

SEQ ID NO: 7370 - protein, 152 aa, Methanobrevibacter ruminantium
MSILVAYYSRTNVTKKVAESIANQLDADIEEIVPKVKYDGKIGYMRGGKDAISEKIIDLDSLKYNPADYDLIYLGTPVWAGRAATPVISYIKQNEGSFNDVKFFVTAGGSGFEGTIEQLGKYVGKAPLKTLSLTTKQVKRDEFKDELASFIE

SEQ ID NO: 7371 - protein, 116 aa, Methanobrevibacter ruminantium
MLFIYYPRCSTCQKAKKWLDENGFDYDEQHIVDDNPDYEQLKALYEKSGLPLKRFFNTSGKIYREMQLKDKLADMDEEEQLNLLATNGMLVKRPIIETEDTCLTGFRQKEWEEKLK

SEQ ID NO: 7372 - protein, 276 aa, Methanobrevibacter ruminantium
MDYIRQTEVIQWNDGAYQTINEESVEDEYTYLFIDYLPPRKFSTYPKDLEDFAVGYCLGEGLIKDYSDIKSIQLDGTNILVTTTLSHDPEEDLEQEGIVQEKKGNCEHACVCRLLEYQGVNSDNAGGIRSELKTIEPNTSDLKIDASQIIKDIEHLTDEAKIWQRTAGVHVAQLKYEDKIIIREDVSRHVAVDKVIGAASREGYDFSKCYISYSGRMPADMLIKVIRVGIPIILSNAAPAASGIDVAQTGNITMIGFIRDKRFTVFTAPERVNLDA

SEQ ID NO: 7373 - protein, 401 aa, Methanobrevibacter ruminantium
MKYNFESIIDRKNTNSLKWDLFGDEYPMWVADMDFYAAPLIYESVNRKANHGVYAYSFVNEDVYDSYINWWKKYGLDMKKEELLFATGVMPSITSIIRAFTEIGDNVLIQTPVYHVFFYVILDNGRNVVENQLIYNPDSDDVETAYVIDFDDLEKIFKDPKTKLMLLCNPHNPVGKIWKKDDLERIAVLAKKYDVIVVSDEIHCDLTDPDMTYIPFASLDDDLSKNSITCISPSKTFNIAGLQSSAVFTQNKGFYEVLKGQLATDFFSHPNIFSIDATIASYKSEDWLNELREVLFNNKMIVKEFLEENIPEIRLVPANATYLLWLDCSKLNKNEDIESSNYEFSKTLSEFLREEVGLFLSPGVQFGQNGDNFLRMNIACPKDLLIEGLNALKEGIDKFKS

SEQ ID NO: 7374 - protein, 172 aa, Methanobrevibacter ruminantium
MADFEEIIKIRRSIREYEDKEVEDEKIEKILRAGMQAPGSRLGAEPWEFLIIKNKEVLTKIGEIKPRVTNAPVAILLIANIERAFYKTVWQQDMSAAAENMLLEAVNLGLGGLWNGVAPDEERMGKIADIVGLPKDDNLKPFCIITLGYPAEGWENKFMDKFDESRIHYETY

SEQ ID NO: 7375 - protein, 190 aa, Methanobrevibacter ruminantium
MNKPVFYDADCLECFLFVDATYILEELFSKIIIPEQVYNEIMEENTPSLVKRNFKKLKEGFVEIQEMPFGSSQYLAYKSIEKGFWSKAGQICGSGESAAMALAHLNNGIIASNNLSDVEEYIESLDIGLITSSMILTKALEMEIISEDTASSLYLAMIERGIKLPQDSFWEYFDKLYEIDCKRFLKNDFP

SEQ ID NO: 7376 - protein, 240 aa, Methanobrevibacter ruminantium
MNSTVLAEILRHEWGIESFASVNIRSLVYNNIRNLTVLWFPMKANISGCCSKTNEDKVIFINTNHSIGRQNFTLAHELYHLLYEDIDDFIVCGINMNTPSERNADEFASTLLIPDSALYWFRNKNQIDDWSVEDLIKCEQYYQVSRSTMLNRLKSLNWISQDQYDEFGLNVVAEVNRLGYETGLYKPSPQDQKYSSIGELVRLTEKAYGKKKITGGKRKEILLKCFRNDILYDNEVNKLE

SEQ ID NO: 7377 - protein, 108 aa, Methanobrevibacter ruminantium
MIDVVAKNLKDLRKKNGYTQEQVSDYLGITQSNLSKIENGERNFNMTLLDKLCLLYNCSPEYLIGETDLYEKSTIAFRSDEKVDLNVVAKMNEITGFLKLLRSLDGVD

SEQ ID NO: 7378 - protein, 425 aa, Methanobrevibacter ruminantium
MLDIKLFRENPDLIFDSEKKRFRSTENAEKVIEYDTLWREGESRLNSLRAEKNKLSKSFKQAKKDGNIEEVIAQSKAVAEEIKELGPKIEEYKQLREDYRYKVGNIIDEDVPVSDTEDDNLIVRTVGELPDFDFEPLNHVDLIEKIDGADIETAASIAGARFYYLKRDILHLNLALIQFALNELEERGYIPLQTPFFVKGEVAAETSELGEFEETLYKVENEDLYLIATAEQTLAALHRDEIINPEDLPMRYCALSTCFRKEAGSHGKDTLGIFRVHQFEKIEQFIFSTPEESKNEHHRLLEVTEDIYKKLGLPYQIVAIVSSALNDNAAIKYDLEAWFPGSKTYRELVSCTNCGDYQARKTKTRYGRAGSGDAQTLHTLNSTAIATERTMCCILENYQQDDGSVKVPEVLVPYMGGKTVIEARK

SEQ ID NO: 7379 - protein, 193 aa, Methanobrevibacter ruminantium
MIVVTTPMCKQIVEWAGLKEFKVNKFPDEEEGDLAILLSESKVKMNSLTLKLNTFSQIRESILKVSNYCFEHDLTDHLLSDDDIDDIFSSYDLKYANLGDDDFDKIRESNSNKKVKVYSEFLKDIVLDIGALVVDEDYSYVVYPDYLKDIVDKNEDFTDSSIVFIEMPSHGKVSKNPLERTEERYSILINSLI

SEQ ID NO: 7380 - protein, 260 aa, Methanobrevibacter ruminantium
MQIIKTSETEAEKVIINLSQEKSHSKDVSIMVDALRASTTVTIALDYFKEVIPAFTPEEARELSLKHNAVLAGERKGVKLEGFDIGNSPGEIKEFETNKKSMVLTTSNGIMTMENMQNPKHVLVGGFINAKSVAKAAVELAEEEIEIVMGGYNHEFAIEDFLAAGEILFYIEKELKERNMTPKENDGSNYELKDREGFSEYAISAILASRNLELTNEQVLKSKSGKRLSYLNYSDDVELCMKRNITENVGILKDGKIVLY

SEQ ID NO: 7381 - protein, 91 aa, Methanobrevibacter ruminantium
MYVIFRCDCGRVLYAKQGVKTRKCTCGKTIKVKSRRILQKVETANDASLAVQKMQEEIYGGTAFKTADEYKANKFINQLDRRMKEYEDGDF

SEQ ID NO: 7382 - protein, 448 aa, Methanobrevibacter ruminantium
MEMDSIIIISEILIIIILIVLNGLFSLAEIAVVSARRIRMQKIADDGDKRALLVLDSMDHTSEFLSTVQVGITFTAIITGALGGTTFSEPLGNYLSQFIPYSYQISFIIVILLTSYFTILVGEIVPKRMALNDPEGYALSTAKFMQISSIICKPIVKLLDSSTNLALRIVGPSPKEDVVTEEEVKLLIEEGIEDGTIAEEEEDIIKRVFRLDDQKVDMIMTPRNEIIWLDLEDEIEINKAKIIASKRSIFPVADAELDDFIGVVQAKDLLSKIFEGEDVDIRANVKSPLVVPENMLSMDLLKEFKENREYVHMVLVVDEFGSVVGLITLNDLLEGIVGDIPGIDEEDDPKAVERKDHTWLIDGRFSIEDFKDLFEIEKEMPNEVEDGYTTIAGFILSHAGKIPETGEIFHEDKFTFEIVDMDGNHIDKILVTINEEDSDKLDLESKED

SEQ ID NO: 7383 - protein, 313 aa, Methanobrevibacter ruminantium
MELIIQIILLIIGFVLLIKGADVFVDGASNVAYNLKIPTIIVGLTIVAFGTSAPEAAVSITSAFAGTNAISLGNVVGSNIFNILAVVGVSALLGTLTVDKVLIKRDFPFLVVSSIGLLLIATIFGEISRLCGIIFLIIIIAYVYVLVQEARQDKEAMSEEIEVKLSIPKAAIYIVIGIAGIIIGSDLVVDSSSYIASVFGLSDVLIGLTIVAIGTSLPELVTSITALKKGDNGIVIGNVLGSSIFNILFILGISGAIMPLPIAPEMVWDILLMTVITIIGAAFAYTKNEVDKKEGAVLVALFILYMAFVILRN

SEQ ID NO: 7384 - protein, 285 aa, Methanobrevibacter ruminantium
MSINKEEFNEKIFSRINNLIDDYQLIKEGEKIAIALSGGKDSVLTLHALKNYKDSADFDFELVAILVDEGIDGYRQHGIDAAVNNAQLLEIPLIQKSFKEEEGFALDDIYSYFKSACIPCGVFRRNILNKTAYEIGADKIATGHNLDDEIQSFLMSFSRGDTVKFSKFGPELDQIHEKLVPRIKPLWNTPEKEVGMWAILNGVEIHLDECPYSNLSLRAKIKEFLNKTESKHPGTKENVLNSFIKTLDVENVRTVLSECERCGEPTSGRVCKACEIKDIISENRD

SEQ ID NO: 7385 - protein, 91 aa, Methanobrevibacter ruminantium
MGIEESGVGEYVSKAVQIIEESGLNYQITAMGTQIETDNLNKLYEVCANVQEAIFEMGVPRVYTVLKIDDRRDKENRTLKEKVKSVEDRIK

SEQ ID NO: 7386 - protein, 157 aa, Methanobrevibacter ruminantium
MAPVVEQPVEEWDKDIAIDLTGVFYCCKAFGEYMVKQEYGKIINMGSIHSRVALTGGLITGYTSAKGGVYNLTKTLAAEWAPYNITVNAIGPAYFESELTADVVGDEQFDMLIKAFCPMGRWGKEGELDGIAIYLASDASSFCTGQLINIDGGWTAI

SEQ ID NO: 7387 - protein, 367 aa, Methanobrevibacter ruminantium
MADIKVSIASPIIEEEEINAVVEVMKSGMIAQGPKVIEFEKEFADFVGAKYGIATNSGTSALHVALLAAGIGKGDEVITTPFTFAATGNSILYTGARPVFVDINEDTFTIDPCKIEEAITDKTKAIMPVQLYGQAADMDPIMKIAKEHDLIVIEDAAQAHGAEYKGKKVGNLGDMACFSFYPTKNMTTSEGGMITTNNEEFAENARIYRAHGSATKYHHDVLGYNFRMTDIGAAIGIEQLKKIDGFNDKRIENAKYLNEGLADCDLVETPVVEDGYKHVYHQYTVKVKDGKRDALSDYLIENGIGNGIYYPIPLYDQVLYTDMGYNQSLEVTDKTVKEVLSLPIHAKLTKFDLDLIIEKVKKASKEL

SEQ ID NO: 7388 - protein, 405 aa, Methanobrevibacter ruminantium
MEEYKDNFPQEELKTYTEDELKIIEEGKVKIKFPDFDKVSSDAPVFYNPKMEFNRDNSILALQAYQKEVDREINICDLFGGSGIRGIRYKKEIEGVGEVSVNDISPLANEFTRINAELNDVEVNIDQKEANIELRTNMGLFDVIDIDPFGTPSPFVDSAAYNLKRDSLLCLTATDTSCLSGTYPEPCIRKYNAKPYKSEYYHENGIRIIIGFAALTLAKYQKHIEVKMSHSTEHYMRVYLKIIKGSKATDKSLKNIGYISHCKNCLYRTESHGLATSVPDICPECGEKLVTAGPLWLGPIQNKEFIESMIEIADEKELNTKKKVLKLLNSCKMEADAPATFYDIHKICRSLKISAPKLDLVFDKLKENGFYAVKTHYSPLGIKTDASSRELIEIVKELAEEVENK

SEQ ID NO: 7389 - protein, 159 aa, Methanobrevibacter ruminantium
MCAKVNEDIIQLDETDISILKIINDDVRISYRQISRDLGISVGTVHNRIDKMLKTGVIEKFAPVLNHKKLGYALTSIIGVNVKGQELEQWEHDISKNKNVVGLYDVTGQYDAIVIAKFKDTDELDTFLKELLKTGCIEKTITQTVLNIVKEDVGSADIL

SEQ ID NO: 7390 - protein, 313 aa, Methanobrevibacter ruminantium
MVVCLPDTQDDAPRIPIHLSRVGVTGVKKLLTLKRKEKRPIILLPTFDAFVDLPSDQKGTHMSRTPEAISEVVEEVAQSSQKGVESLCADIVTRMLEKHEYAKRVEVSMVSDYMFMKDSPVTDNRSQEMGKLIANAVGIREDDDTISIRKSIGAEVIGMTVCPCAQESVREVDKNNLLKFLDEETCQKVLDTVTFASHNQRGVGTILIEVPEDEYVDGEKLIEIIESSMSSPISELLKRPDENAVVMNAHKNPVFVEDCVRTMNEKIVKEFSHLPDDTLITTRQENQESIHRHNAFAEKVSTLGSLKEELNIN

SEQ ID NO: 7391 - protein, 93 aa, Methanobrevibacter ruminantium
MIFMENFENQKFCQSCAMPMTEELYGTNADGSKNDEYCIYCFKDGEFTSDMTMEEMMNFCIEKMVEVHPEMDKEEASKMMNEVFPMLKRWAKD

SEQ ID NO: 7392 - protein, 394 aa, Methanobrevibacter ruminantium
MNVLVCSMSAMAETAGPYGRARALVEALKASGIDVATCMAEDINYKPIDGIKNYYLNVPMPLGLPKPIATRTFPIAQKLGIIERKNVGSFEDVLHFTGNIDYKYLCESVANIRKAINDFNPDIIYSEFNISAILASKLENKRLYATISYPTQTEYASNPKYAKGLKKFLRENNLPDVNSSLDLFNWADKSFVPSIYELEPIDKDNVTFCGTWKNLNEGSVFKENDENMDSTDERNAILVYMGSGTISPNKMFKEIKDAFIGTEYQVYIASLGLEKSDFDNIHIDKRWDFSKLLNESVLFINHGGQNSVVDGFIYGVPQLICPGRVFERIYNGKSVEKVDAGKILEITDFKGEIIKSESEKIIKDDSFRNNSKSIGDKLKSLNGIDLIIDSIKKG

SEQ ID NO: 7393 - protein, 447 aa, Methanobrevibacter ruminantium
MKMYKINVSNISRLRTYTDGDGVSTLIGSMGCPLRCAYCFNPFSWDGSLEPKTYAVDELYEEVKRDNIYFLSTGGGLVFGGGEPLLYHEFIKEFIKKYKSTGWKFTLETSLSVKKDILRDIIDYIDFFIVDTKDMNKNRYELYTKGDYELFLSNLKFLIDKVGSDGIRVRVPKIPKLNTVDDVKTNYRTLKDMGFSNIDVFNYVEIAKHRKISRVALENKKDFDERLYENKIKFVEDYILSEIMLKVPPILDFHIKKFPNSFNKKFEFLFEYDSIFNDDLFFLKEVVISKLQECYDYLDLKYGFFVIFYPVGYLENRLDDSCFDLSIMNNLVKSFEGLDEIDKEKHALELWEENKWEYIEFKYFCHDLNHLKNFYVNFKDHGYKLDSKYILSNAYDVCPSDFVVHINLRKTGKTYNIVEEDYSTHLLVQKFDKDMNLISQSIFEKGI

SEQ ID NO: 7394 - protein, 89 aa, Methanobrevibacter ruminantium
MKGKDKCELLKNIRQKIADENNIEYTAVECTFQGDCTGTCPKCESELEYLDKELEKKQNAGENINIKNIFSSDDFDKSEYGLLDENILG

SEQ ID NO: 7395 - protein, 141 aa, Methanobrevibacter ruminantium
MVDEIDRFDGKYLFLSNFYICDVEYDGILYPHTEAAFHAQKVFDDETKMKFTNVTPKQSKRLGRKVKLREDWNEVKDNIMYEVCKAKFEQNPDIRKLLLETGDATLIEGNTWNDQYWGVCRGKGRNQLGKTLMRIREELRE

SEQ ID NO: 7396 - protein, 510 aa, Methanobrevibacter ruminantium
MNETKKQVSWMPLILVAFASFIIALDATFMNVSISPLVIDLNTDVGTIQTIISFYTLITASLMLISSKMQDVFGKKKIFLTGALVYGLGAFIASISQNAIMLFIGWSLLEGIGGALMTPATISIISGTYDGQMRTTALAISSAIVGIAAAIGPLFGGVVTTFLSWRYGFVFELLIILIIFIFRKRIPNFASTASKKDLDITGSLLSAIGLILLVLGVLMISGKTIGLSIGLIIASIIVLIGFGLFEKRRKANGKMPLFDVSLLKDRNLSRGTLIRLITAIAMGGSLFSISIYLQTVLKLSAFNTGIVLLPLTFGMLIFSIMAPKFAIRLSHKYAMIIGFSIAIVGCLLLSYQFTLTTRFIDLLPGMFIYGAGLGFPMALSVDTALINTPPESQSSASGFVSTGQSLGMSMGTAIIGIILIVGAVGGMHDAINTYAPDKVTNQEFHDNVQGYFEKLGNVNTTELKHENSLKEKIVSKVVQDAMRLVMYVTALLLAIGGALTFTLKKQKIKG

SEQ ID NO: 7397 - protein, 155 aa, Methanobrevibacter ruminantium
MYKKLMILALFCFIVIGSASAADFKINDGFNSSLSDYSFYNEDQNMYINIWDYDDEILSEAYLENSSSYRIVSGENNTYNFVFDSYNDMDHVISYITKGYVALDCGVLEIAEVDGKKQIILVSKEGTNVDSLKTCYDELMKFNQNNNIEPIADAI

SEQ ID NO: 7398 - protein, 645 aa, Methanobrevibacter ruminantium
MRINKSLLMISLLLISILAISAASAADDMVDADIDLASSEISEVSVDDVQATDKNVLSDADEVSVVTQNTPYNENATIDISVNGTLADDSTIKLFIDGEDKGDLNLSAEGKASYVIPASTLDVGKYFIEAVVHNGTSSFGGRSTLNITKVTPIVSVSDVTVKSGDYITIPFNVTDDKGKAIPGDVIVTIVWENDVISKHIKLNDNSSAGFNIADIIGIFGGNSTGNGTGTGIGDLFNRNGTNGTGNGTGIGDLFNRNGTNGTGNGTGIGDLFNRNGTNGTGNGTGIPGIGGNSTGNGTGNGTGDFDIASILAMLMGGGNNTGAKFAYVFEKGVYNVSVEYLSNRNYNGAINDTAKLTITPLEDVLINATIETAKNMSDNTTVSILLTDGYEKPIAGGEINVFLNGEDKGKVTANEEGKASIAFSNLLKGDYELLLNYKETNKTFDFFVNVERMGTVIEYEDMNTTSVNEKVDGRIGEYFQVTLKDNEGKALANRFVQIGFNGKIYNRTTDDKGQTKLQINLFYTGDYTFAVCYLGDDAYNASFIVAKIKVSKQTPKITTKDATYKADAKTKNIKVTLKSAKDNAIKDKKISVTVNGKTYTAKTDEKGVATVNVSLSKKGTYSFTAKYAGDSGYAQVSTKGILTLK

SEQ ID NO: 7399 - protein, 81 aa, Methanobrevibacter ruminantium
MELVIFKAENKLEEIFLNAQLKMQKAKNELIKNMEKDIEKAIELAAIEVETQIIKENIDIAVDALEETIEEEKADLAERFE

SEQ ID NO: 7400 - protein, 153 aa, Methanobrevibacter ruminantium
MSEILPKITGQIIGHFNAFKGSRPAFHGEHTLIVRGISRDKIEIEEMEPKLAELEDILKAREVDVLSDAGKNFVEKVDSYIRDAESIDTAPDSGGLLRMKEQLETMGLHVEYKLFLMPYAGAFVAIWKDKSGFGPLYVEVTASEREETDNDMK

SEQ ID NO: 7401 - protein, 363 aa, Methanobrevibacter ruminantium
MSNLSNIDFENLSRNDLISILECKKEDILKIMDLANSKRENTFVTYSKNVFIPITKICKNDCGYCAFKQSPDDPDATILLEKEEILATLKEAEKYGCKEALFTMGEDADEEPAVKIKLEKLGYENMPDYIYDICKMTVEETDLLPHTNAGNFSYEDMKKLKEYNISMGMMLENSSERLMNTIAHKKSPGKDPKIRLETIENAGKLNIAYTTGILIGIGETKEEIADSLLKIKELCDKYGHIQEVIIQNFTVSPGIEMESHEEPSLLDMVRTVAAAQLLFDEDVSVQVPPNLNYETSQIFLLCGTDDWGGVSPLSEDYVNPSSPWPTLERLEKLTNDAGYQLKERLAIYDKYINEKYIEKSYIN

SEQ ID NO: 7402 - protein, 440 aa, Methanobrevibacter ruminantium
MTNEDNKNMTIIGASRGLGKWIAQHLKEDFNITITSRNQAEGQEVANELKVSYNNDNIDAIKDANIIIFSVPIEHMATTIKEVAPHAPKGSLLMDVASIKKEPAEALEKYAPKDVEILPCHPMFGPRVPTLKRQIVVLTPIENRSNSWTLVKEYLEKKECEIVITSPDEHDKYMSIVQGLTHFSFISLASTIKKLNINVKKSRSFSSPVYSLMLDMISRVVYQNPYLYYSIQKNNKETAYARDALIKESMRLSKLIEEGDEEDFVKAIAESAEHIDEIEEALVRSDKAISMLNQKANILTKLIGEEVGLEDAFSKKAYIGIVRKVSSQTVTIENENNEEIELKISSIDIMDKDELFQWKKKNLKLESFDLTAKFPSSANEDYLLKMFKRIEPVIDANIIFKDKEIEKDLRTYKFHYSLFNKQEKDYVEKYIQGIGGILIK

SEQ ID NO: 7403 - protein, 256 aa, Methanobrevibacter ruminantium
MKWKKIGDILIIDDNFDLDLNDEKTLKDLAHRHKVKSIIRIEKIEGQKREPTIDILYGEDTETIHKENGCLFNLDLSKVMWAKGNNNERLRIAKLVQKDETVLDMFAGIGYFSIPIGVHSQAKQIYSIEINPNSYHFLKRNIELNKINKKAGYDRMIPILGDCAIEAPKYSADRVLMGYVKTTHHFLHPAMECVKDGGIIHYHETVPDKLIETRPYERVKEMAWNCGEREVEVLNIQRIKRYAPGVEHIVLDARIY

SEQ ID NO: 7404 - protein, 207 aa, Methanobrevibacter ruminantium
MSNKNTFEGTTTVGITCKDGVVFASERRASMGNLVAHKVAEKIFKIDNHIAATIAGSVADAQTLMKVISAETSLYRLRNGKDISLEAAAAVSSNILHSSPAYVQTLIGGVDDTGASIYSLDAAGGMIKDTFISTGSGSTFAYGVLEDRFYEDITVEEATEVAIRAIKAATERDTFSGNGFLVANVTKDGFKMLEKEEVDAIIEKINS

SEQ ID NO: 7405 - protein, 636 aa, Methanobrevibacter ruminantium
MASNVLEQIKEEITKKLPEEVKLANIEFEGPEVVIYTKNPDIIADNGDLIRNLAKDLRKRIIIRSDKSVLDSYEDAIKKVEEIVPEDAEINDIKFDEVTNEIVIEATKPGLVIGKYGVTSRDIVRNTGWAPKILRTPPMRSEIIDRIRNTLLNNSKERKKFLQTLGARIHQGGKYPSDWVRLTAMGGFKEVGRSCMLLQTPNSRVLLDCGVNVAGQDDKTSFPMLGVPEFSIQDLDAVVLSHAHLDHCGFIPYLYHYGYEGPVYCTSATRDLMTLLQMDYIDIAHRDNNPLPFNAKHVQKEVKHTITLDYGVVTDISPDIKLTLHNAGHIIGSAMCHFHIGDGAHNLLYTGDFKYEKSRLLEPATTRFPRVESCIMESTYGGHEDVTPSRNNAEKELMKTIYKTIKRGGKVLLPVFAVGRAQELMIVLEEYMHHDIIETVPIHLDGMIWEATAVHTARPEYLSKELRDQILHMSRNPFMTESFNQVQNNAERKEIVEGEPSIILSTSGMMTGGNSVEYFKWLCEDKKNTLIFVGYQSEGSLGRKIQKGHKQLPFEDEDGKTRVFNVEMEVKTIEGFSGHSNRRQLMEFAKRLHPRPDKIITCHGDPYKTVDLASSIHRSFKVETKTPVILDAVRLQ

SEQ ID NO: 7406 - protein, 339 aa, Methanobrevibacter ruminantium
MVTYSESGVDIDLEALTVSKLASKLKPTLEYRNIITDSGHFAALVELGDKAIAMSTDGVGSKILVAKMMEKYDTVGIDMIAMVVNDILCVGAEPIALVDYLAVEEPDPKVAEEIADGLVKGATESKIAIIGGETASLPGIVKDFDLAGTGIGFVDKDKIITGADIQEGDILIGLRSSGIHSNGLSLARRAIFEDGGFTVDDKMPNSDTTIGEELLKPTQLYVKAIIDLLGQGFNIKGLAHMTGGGVNNLSRLKDGIGFEITDYPEPQDIFKLIYQQGVPLEEMYKVFNMGIGFTVIASPEEADAVLEALNKNIESYIVGKVIGEEKIVVKTFEGTEITY

SEQ ID NO: 7407 - protein, 329 aa, Methanobrevibacter ruminantium
MNISVNKERELVKEILTKIGVKENQADVVTEATIDSDLKGFTSHGLGRFPQYIRGIKRGHIQIDGEYDIVQETESIALIDGKSLFGQYIAHEAMSLAIEKAKKTGIAAVGTFNANHFGITGYYSDLAIRNDTIGIVICNTEPGVAPLGGKKAILGTNPVAIGIPSDTYIAVDMATSVSARGKLLEAQRKGEEIPPNTAIDKDGNPTTDPEAALEGSILPFGGVKGYALSLMIEIMSGPLVNAAFGTKVTGTAGDYKENCNKGDLFVAIDPSKFVPIEQFKADVEEFVTEIRESGDTFIPGDLEVKRIAENEVKGLDIDEKLYDTLENNL

SEQ ID NO: 7408 - protein, 130 aa, Methanobrevibacter ruminantium
MVKPVKIHDNNLWDKFVKETESYWAVLSPGTVIAIFIGETDKNFLLIERKEGTVESKFNINNSLNMMDTGLFFTITEEDASDLLDDSSLLTTFIKEGKLGIFCLVDDYAMAEKGLDTLLSDLGFAPSCAI

SEQ ID NO: 7409 - protein, 638 aa, Methanobrevibacter ruminantium
MVKRNIVLLDIDYITHDEKAVIRLFGKVKGGESNDIIAIDDSFVPYLYILPLEDIDKCIKDINGLKEEGEIEFTKLEKVNKKDLQVPKEFIKMTLNHPQDVPKYRDKIWDLNSVKQLREHDIPFYRRYLIDNALVPMAELELEGELIDSFETVDSDDESLEILKLSCPPKTANTDFQEFRMMSFDLEVRNPHGMPNPDQDEIIMIGIDSNVGVRKVISTKGDEFDDDEEMDFIEIVETEKEMIERFVQTVKDANIDIIIGYNSDNFDFPYLRDRAKRWEVDLDLGVDGSGLKFLRRGYANSAAFRGLLHVDLYLVMRRYMSLDRYTLERVYLEFFGEEKIDVPGERIYEFWDNGGDELKNLFKYSLDDVVATLKIAMETLPLNLELTRIVRQPFFDVTRMSTGQQAEWFLVRKAYEVDEVVPNKPNMTMNNIRERGSNSGGYVKEPEIGLHENLVQFDFKSLYPTLIISKNISPDVLVTDNISYNAKFEDFETGYDEIDSVLEETPSEDLDEEDYYVCPEHFFKFKKEPQGFIPSAIEDVLNERFRVKNRMKQTEDPVLRKSLDVQQQALKRLANTMYGVYGFLRFRWYSFECAQAITAWGRQHIKKAMKEAEDFGFKAIYADTDGFYAKYVPEMKKE

SEQ ID NO: 7410 - protein, 269 aa, Methanobrevibacter ruminantium
MNVPQVLEIKRIIEETPSIKTFIFDWTMVGENIPTPGQFVMVWNFNDEKPMSISYIDIAKGELGITVKNVGEFTNQLHSLEVGDRLGLRGPYGNGFDTDLRDMKVLAIGGGVGMAPIASFAEEALKNKAIVDVVCAAQTKDELLFDERLKEKGATVYTCTDDGSCGFKGFATHRAIELMAMKKYDWAVVCGPEVMMKPLYGTLESNMIDGEYSMERYMKCAIGVCGQCCVDNTGWRICVEGPVFSTDQMSEIIEFGEFHRTASGLKEFY

SEQ ID NO: 7411 - protein, 426 aa, Methanobrevibacter ruminantium
MEYYITQFIAGFIAFDEDLKIANYKLFDDENIVSNNLKIENKELLEEEIELINELSSDDSTIIIETRKRRSQYKELDNYENIIVETPNKGGEHLRNNLESILLEIGFLNDDKENIDDVEENISNLEEPNQEKYSEITKIYEDIASLKVKESSQEEDKLLIQAINTVDDLDESISKLVERIRDWYTIYFPEMDTIGSNETYIKLIAESENREDIIKNHKEHFDIDLDFSTGADIEEYDLIMVKSFAESIYSLQRSRKDLEKYIDTKMEEIAPNLRDLLGPTLGAKLIAHIGSIKRLATYPASTVQIMGAEKAIFRHLKTGERPPKHGLIFQHPSVRGAKWWNRGKVARNLALKITLAVRKDVFSGEYDPKIAEDYLKKVEEIEKENPFPKKTSSRRKSERQMEKDKKSKKYKGNKKNKKNKKRKKRK

SEQ ID NO: 7412 - protein, 216 aa, Methanobrevibacter ruminantium
MEIFLKDQDIVTRNLRPGIKVYDEKLIQEEGSEIEYRSWNPRRSKLAAALLNGLESLKLENDSKVLYLGASTGTTVSHISDIAYDGLIYAVEFSPVSMKKLIRLSKQRPNIAPLLEDATKPKNYLNKVEKVDLVYCDVAQEKQSELFMNNMKLFLKEDGQGLITIKARSIDVVQKPKKIFKEEEKKLKANGYSILEKIKLEPYEKDHIAFLVEKSF

SEQ ID NO: 7413 - protein, 244 aa, Methanobrevibacter ruminantium
MNQDKMKLMQILKNLERDYNDGLISEEKYIYLSNQYRHKIDTIDTSNRIRTMQGKKKVSPRPYSKYEDANYQKSRDEDERLVEKYIHNPESYNINSRGKKTKSGGTSPWYIALAVIFLLFAFGAGISFGIFSENTNSDVGDIITASATINDTAFPEVKQTYKYNRTSNYTKYSSNSYSSDYSSGSSYNSYNSYGGSGYSSGGSGYSSGGSGYSSGGSGYSSGGSSYSSGGSGYSSGGSGSVSID

SEQ ID NO: 7414 - protein, 275 aa, Methanobrevibacter ruminantium
MINDKVAFLGPQGTFSHEAASLLSDNLISYCSIQSVMDAVERGECRYGLVPIENSIEGPVSLTLDSLIHNFDLKIRNEIIIPINHNLLAASDISVDEVENVYSHAQALGQCQPYLERHNMVAHYTLSTAAAAKHVAETGEDAAIGTLKAAELYDLKVIDTNIQENYNNETRFVVLDTEDSPITGNDKTSISFSLFEDKPGGLYELLGYFASENINLTKIESRPSKEGLGHYIFFVDLEGHRLDENIAKILNNLEDNTSFFKILGSYPVYSRELFD

SEQ ID NO: 7415 - protein, 272 aa, Methanobrevibacter ruminantium
MKIKNIMSENVVSIDKNLNICDCLRMMYKDNLSRIPVTSTNENKKSLVGIISEKDIANKLGSVKYGNLAPSHFHVSTVMVKDLITVDADDDLTDVANILIEKNIGAIPVLSDGEMVGIVTKSDFIYLCKAKAYEKVSVKDIMTPDIISISANDRLIHARKVIMDSGVGRLLLTEDNELAGIITSKDIAKALVSFRKHTPEKHMASKIKELVAGDYMSTNVQTISEDTSIPELADAMLETGYNGYPVVDSNDQIIGIVTQSDLLKLIYEMETQ

SEQ ID NO: 7416 - protein, 294 aa, Methanobrevibacter ruminantium
MNRGSVEHESKVAENEGEIMTLAKKEVISIPQTKTIKEAAEMMIEHEFRRLPVTQPGSNKLLGIVTAMDILDFLGGGSKFDIIEKKHNDNFLAAINDQVKEIMTRGVISVGPKATIRESVTKMTENGIGSLPIVDKEGKLVGIVTERDFALALAGSLTNETVGDLMIKDVITTTCGTPIESCSKIMVRNNLRRIPVVEEDKLVGIVTSTDILRFFGDKEMFASMTSNSGLDVLKRQISDIVKPNISVTESYVKLGDLCDLLAEKNIGGVPVVDDNKLVGIITERDILNAVLSKK

SEQ ID NO: 7417 - protein, 370 aa, Methanobrevibacter ruminantium
MAEIKKQVRTRDFIISTDGLLFASTNYIHPEDRIISFLRYIPDENGDREKDGIKYSKVGSDEAYAYLRENHPDYLYFCDVTNVEMMGVPIDKVERIIKPEERLKGLRETYIPIINEKLEKGEDLDYKEELMSKLIDLSDFFHYMASIDYNDLGISGSILPGLQKAGTSDLDFVVFGLENHRNAIKAYKENKDKPVYIEELDKEITLNRINDDFWDFVYDKRIKDDSLTKEEFAWYEERKSNRGLIRETLFDILATRNYDEIEGTWGDTVYEPEGFAKVNCTIKSALGAFDNPAVYTIEDVEILEGPDIEISELASLTHTYAGEVIDGEEVVARGKIEKVLKNGEFEKYRILVGTTRESLNEYIKLRESPV

SEQ ID NO: 7418 - protein, 1498 aa, Methanobrevibacter ruminantium
MKYKKELIFICFIICMLSMASVCASDVNDTYINQNDLKIDNQDNCINYEKVVYTEENLENNLISTEDSLEDSNSIEPSDSFKQKNSLNEGNSDERLNPEIDVALNSIHVNETAEVNVTVRNASGYVLVSVDDQSFNKDLTDYQARFNITGLGFGNHNIAVYYGGDDNYLPGFKLETISVEKYQTQISEIEIGEVYYGEDAIIEVSVPNGVEGDITIKINDTLQTVITEAIHDGMALFSVSGLAVGSYSLDATYNGNDYYENDTASAEFEVKKADPNLSVVSFECTVYDNATILASINEEIHDEFVNITVGDEKYEDCPIEDYGMIAFTGGVLSNFSSYRILIEYGGNENFESAMIEAFVTPKKITTYGLDIIAQNISINDDEIISVVVPDHVDDVVVWVDGQSYRNCSFENNVAVFNVTGLGEGVYTVTATVNDTEFDHKNFTSIFTVSKVLPSIGISINETEIYVGDNVKIIVSLPIDVSENVSIVFDDRELSQKPVDGNATFYIDCLSYGNKSVPAIYYGDEKYRTAVESINFTVNKVPSFLNVAVENISISDNEVINFSLANDASGNITVIVNDETYIVAVSGGKGTLTVPKLNQGVYSVNASYNGDGKYLPSLNNSESFKVLVNSGQMEIIDERNNTVSVYLWDGATGNLSVKIDGKVYNATVVDGFAQVVISNASYGAHHAYVLYEDNESDLKLESVVDVFVPKYLSPIGINSSILKVGDIGYINVTVPMGASGNISLEIDGKSYLIAIDNGIAEFEVENLTAGDKTIFVKYSGDKVYSQNSTSESLTVFKQESSTHCSIEDISVGDVAQIKITGPSDVLGTVIVIINGSEYTASISNGEGILNVYNLQNGDYDIELSYLENSKYLSSEYRDNLSVSKIQTAISSSNIVCQYNYEGYLNVSLKDIKGNPISCAELSIDLDGVKNLVSDVNGQVKIPTKDLDANDYSVLISFAGDEKYLPSNATVNVTVNKDIPQIIASNLIADYKSDDYLIIGLEDSQSNPLAGFDLSIALNGIDGDYDVYSTDSNGIVKVPIKDLAANDYIASIVFKGNANYDAINSTVKVTVEKALSSLFALDLVTVHESDDYMIIALKDSCGNPLVGFDLSVDLNGIDGDYSFNEVYSTDSNGMVKVSTKDLDANTYDVKVKFDGNENYTESNITGSIIVREDIIIVPNASIAFTANDSSVSAILSNLDGVPISNASLDISVNGDESTLITDANGRVAIKINGNSTVIASYKDENNLSTTGYLNVIVKDNITVVEKNNTIYVNQTVEVPVYINQTVEVPVYINQTVEVPVYVNVTPNRTATMIVYNNMTTVAVAKVDGRVGEYFYVSLKDAKGNPLANKLVQIGFNGRVYDRTTNATGGVGLQINLGNEGKYTFAICFLGDDNYTGSFEVALITVSKHSPKLTAPAKSFKASAKTKSLTATFKSSNGNPISGKKLSFTVNGKTYTGTTNAKGVATVKISLNKKGTYSCTVKYAGDTMYKATTTKFNVKIV

SEQ ID NO: 7419 - protein, 312 aa, Methanobrevibacter ruminantium
MLSISTIKTYMFCPLKLYFQSEIDEIYDEEEYFVPKTLKDLRIDIQDLLHKNLRLVKKDMELKEIEETLSKGVFNQIETTFEIIEELNETKKEKERREKSSIYKDSNIEFLDEDRQILNASLEDNDGTLEDLDNEEDEIKKLKDEIIDEVNLNLKILSLKASQAMKNLEKDGNEIQNLFFQSSMYNTLIRDLGIDLIGVIDKIEVEKGKYFPILLKTSNPPSKGVWQSDEIELIANALLVEGEFNTYITVGFVEYLKIGERRPIVIDTFARKKFFKLLTKINKIVEDGEIPHVKTSVKKCRNCEYRELCEKA

SEQ ID NO: 7420 - protein, 219 aa, Methanobrevibacter ruminantium
MSSISLTITTKEEKGVLDEITDVLTSHGVNISYVHLYVKEDVGTLNLELENINELDELIRDLKSKDFILDIEIHGSLNDIFGKRVLIFGGGAQVSQVAVGAITEADRHNIRGERISVDTIPLVGEANITEAVEAVSRLPRVGVLVLAGSLMGGKITEAVRKIKEEHEDIIIITLNMPGSVTKEADLIVTDPIQAGVMAVMAVASTAVFDVKRLKGNNKF

SEQ ID NO: 7421 - protein, 87 aa, Methanobrevibacter ruminantium
MKFVIRPYHMMSLGGYIVEYDFPYRDIIIVNKTSEHIKFEIPVFDESWIEETRALGLEVIPVRKEDSYLNMYRKAHADLDAFKAKLD

SEQ ID NO: 7422 - protein, 391 aa, Methanobrevibacter ruminantium
MEEKKAKKQEIIETEIQMGTVHPAALEPYRVRFFVEDEIIKDAEITIGVNHRGIERVMEGLPVEKANMLTEKICGICSNSHTWNSVRTAEKGLGVEVPDRAVYIRVIVGELERLHSHLLYLGHGCETLAHETFSMRVFYIRETIMDLLAMIGGNRVQYGCSIIGGVRPRCELDDNRIQRILDGMDLVEKNVLDFANRFVKDSVVASRISGTGYIPQEQALKLAVSGPTLRATGVKRDLRTDMYEYDNFDYDIITQDTCDVQAQLLMRVFEIFEAIKIVRQAIRDLPEGKITDRSWEMIDTDLIESYIEVPRGTLYHSYAIEDGRVRHCIIRTPSMSNIGAMQYACIDNHITDGQLCIVQCDPCFTCSDRAIEVYDTNYNKLDKSILKSNIH

SEQ ID NO: 7423 - protein, 148 aa, Methanobrevibacter ruminantium
MSLKTLSRSKAIHIMLVYTGGCNGCDIEIVNAVLSPKFDMEQYGVFLTWNPREADILVVTGPVTYDNRKPLEDIYNAIPNPKLVVAAGSCALMGGVYKNCHGDIPSEEIEGPVENVIPVDAKVPGCAVRPQDVLAGVVAALPHLLNAD

SEQ ID NO: 7424 - protein, 222 aa, Methanobrevibacter ruminantium
MKDVIKIMLNGTYTNFKRILFASDRVTDMELRNAILTGTVEPDKKVDEQACIGCGGCANVCPTGAVTMKPLQTPVKIKEGWVKTEVPELDPFKCVVCYWCHDFCPIYSFFEEAGTIHPGNVGEINIDTAELLSEPIKISQEKISFIAQYLSDKSLLSENIVSDADEIENVGAGLERVSKIKDIQDNINEKYEKDAKRSSALADDSNESSSESDESSKNEGGE

SEQ ID NO: 7425 - protein, 486 aa, Methanobrevibacter ruminantium
MYLTTNKCDGQGDCIRNCPTEAIRFVDNKAFSCMCCGACFEACPNHAIFKNKYGGYVVDRAKCNGCGVCQFTCPIESIHIDNGIVKGICSRCGVCEDVCSRNARTDTDNLVLDKQKVLLNSMKMVANTVGYRAGVKKIENMKLPVKSDKSADRVCVSTDMEKCVKCGRCAYYCPTRAIEVIIQDEGFCVGCKICEDLCPTGALKDGQYDKNLCTLCLACVENCINDALKVKDFKIVRNIKDSSMDNPLCSNTKGTIVSCLNCGLCREKFDSPALIKKENALRYDPSQDKDSEENNEKRLEAIYNCPVSTLSENEDNKLFGYCVSCGKCTQVCNEQARSFQTISWDGEVSDDCISCGICAELCPKEAISLKRGTINVDLDKCIMCETCGIHCPTDAIPKTTSTKYKISGGFNYIDENLCVKCGLCKDICGEEAIYTVDISNEDVNLGTKNKNLRFVVDDDKCIYCGACMNICPSKSFIFEREFNRVN

SEQ ID NO: 7426 - protein, 131 aa, Methanobrevibacter ruminantium
MSDKTSIRSILMVVATIIFASSLFDALYGFKNLIQPGISLVYTAIGTQLAPNMVTLVVFDWRGFDTLGESLILVTAVLVVLLIFGKGKILDKNVNADNGTADSNLTHEADLEIGDSDLELDGADLNEGDDE

SEQ ID NO: 7427 - protein, 111 aa, Methanobrevibacter ruminantium
MTLYQKFLDSVKELKSSFSKDPTTMNNVSGAMAAEFLILVGLILAALFFRHINIAACIVVVILAAILFFTNMPLASKIKSEQSDSLEKMLFYVLIVLGILISVIYWGLKYV

SEQ ID NO: 7428 - protein, 493 aa, Methanobrevibacter ruminantium
MNYLIPLMVVIPILAALIVNILGGKDKTVKAFSIIVGLAIPIIAILAAIGVQYFGGHDPGLLANSLPSNLVGTLVASYNTGIVYIFDNIERIFIFLMGIVAFLSIFTYFTEKKEVSGPYLYLIFMGLASVIALLLSNDIFNMYVFFEITALTQVGIIVASSTEDNYEIALKYLILGSIGGPMLLLGVGFVLGTIGSVNITDIIYAISNNFVDPYSPGLVIGFALILFGWLYSAGLPPFHTIKSAVYSKARPNGSAILQGFSVLCMLAFGIAMYKIFAYIPGFNTAIIVFAILAMVLSIAMSAMEVDFRRMIAFLAVGELGFIALGFGIGTQMSIAAALFQAANEIVITAMLFIGFGSIYYLTNTSDTRKLGGLIGVDSLMGVMILLGGCALAGVPPFNGFVSKLMLVQAALEAGYTELAILAVIVSVVIFFTFVKAFHSVFLEPKPKDLKFVNEKIPRVTVFSVAVLLIICLALGLFPNIVTDVFIPFAGGLI

SEQ ID NO: 7429 - protein, 248 aa, Methanobrevibacter ruminantium
MTQEKNNLDLDHISYETGGFISANKNILNNLNLTKNTKYILKESIKGTPIIKLGTNYPKVMMVAGIHGNELAPQISALNLIDQIHDLDLLGTVYIVPFACPKASMLNSRYFDGKDLNRTSHIEGSVGDLILKKAVELEVSAIGDFHSSAPNSNPGKEGVFCTEVPTMASFRLADFISKVTGSEKIVYSSAGIPFKGALEDEANLKGIPAVTCEVLSAIGYANERICYRSIIQMKAFLQYFGFFDRYME

SEQ ID NO: 7430 - protein, 391 aa, Methanobrevibacter ruminantium
MEKVVLAFSGGLDTTVCVKLLEEEYNYEVVTACVDVGQPQEELEKSQNSADNINAGKHYIIDAKDEFAEEYIARGIKANAEYEGYPLSTALARPLIAMKIIEVAEKEGATAIAHGCTGKGNDQFRFEAIIRSMSDFKVIAPIREMNLTRTEEQAYAKEHGLNLSYDKIYSIDENLWGRAIEGDVLEDPANEPPEEIYEWTKSAEDAKDTPTKVAIEFEEGVPIAIDGEIMGLVDLINKANEIAGENGVGRVDIIENRMIGLKSRETYEVPGAKLLIAAHQALEQLVLTTDELRFAQYMSGLYADLVYSALWQEPLREDIDQAIDHMQRRVSGKVVMKLFKGSIQPLSRESPFSLHSIEQITFEDKETEQSEVEGMIKYHGLQAANYQKLNR

SEQ ID NO: 7431 - protein, 220 aa, Methanobrevibacter ruminantium
MPNTGRCKELLVEDAVVYLRPSDNPNRKTKYSLYYVENNGALVAMFSQEANKIVFDAINKNKVKELSNYSIIESEKTIGSSRIDIYLANHKSNFKDNADSKSIGEDSKEDIIDETYVEVKSVTLIKDGVAQFPDAPTDRGRKHLEELISLKKEGIRAVVFFLVEHPNGNSFRPNWENDPKFSETLVKAYDEGVEILVYKTRNDFEGIELVGDCLDFNLNK

SEQ ID NO: 7432 - protein, 522 aa, Methanobrevibacter ruminantium
MDPIDMMATDYNCEYLGLSRLCLMENAGKSISDEIAILSTYKYSRPVKIVIFTGSGGNGGDGFVAARHLLNRGFEVDVYALNTADQIKSGDALDNLKILMNLEPRVSRLSVQFIKDSADLDKIKLDNNSPCIVLDCLLGTGIKGKLREKVRKTVELINAINGLRVAIDVPSGLDPLTGEIADIAVDADYTVCFHKVKTGVKLAGEGKVGGIITCDIGIPIEAELFVEGGDLLRLNNRPSSSHKGNNGKILIVGGSLDYYGAPAISAKASIATGADLVYIYTPKSAALPIKSFSEDFIVKEAKGDYLSIDDLDDILEMASKVDAVLIGPGSAQNEDTMKLFNVLAMKIDKPLVLDADALKLVDFSLINKKEDIIITPHYSEFKSFFKNQIPRDIERNLDNIVNLNDDSDFVKVNDKIDALQSITASFDGSVILKGQYDFIFNKNKLKINRTGNPGMTVGGTGDALAGIAVSLLSQGLDSWTSAILAPYLNGKAGDLAMDAQGYGFGAQDLTQYLGAVMANLID

SEQ ID NO: 7433 - protein, 188 aa, Methanobrevibacter ruminantium
MKEYLSETKSIDYMNPIIQEKVKELKEQSSDDADYIKRAFLFVRDEIPHSWDIQTNTVSRTASDVLKNKTGICWTKSCLLAALLRANEIPSGISYQLLTIGEDDSFGHMIHALNTVYMDDLDKWIRMDARENVGDDDEEFSLDKDYLAFSPREEFGEVDYQDNNPDLDEKLINLLEKTENLLEMELDF

SEQ ID NO: 7434 - protein, 496 aa, Methanobrevibacter ruminantium
MKRKYITKADLFIVLHYLGYIMQGLGVVLIVPTLVALIYGEYDPIAPFMIPCFVSFVLGTAFSKKFKDYTKLRLKHGMLISSFAWLWASLIGASIMVLSLGIPFVDAIFENMSAWTGSGMTFFVNVEVLPKSILFLRSLEQWLGGLGIVIIFIGILIRAGTAASRLYKSEAREEKIKPNITNTLRKALEIYLIYTAVGIFLFILAGLPIFDAINITFTSISTGGMSIKNANVGFYQDSIVYLISMFLMILGATSFTIHYKIVKTKGKALFKDVQFQLLITLIIVAGAFFIATNKMVPIEELFTIVSAVTTTGANVVDPHVLATWNGSTLIVLMVLMLIGGSSGSTGGGLKLIRIITVLKGMNLTVTNLVSPEGRVVNTRIGGKKINEREIKEASAYIVTFLMFLVFGWIIMTMYGYDPFTALFDVISIQSNNGLSTGIVYGGLPLPLKLTLIFLMWIGRLEIIPVLVLFRTFYGLVNPKRRIKQMKKTNGNDKKTN

SEQ ID NO: 7435 - protein, 224 aa, Methanobrevibacter ruminantium
MYIVIMGGGRVGLSLADRLIIHGYDVTIIENNDELCDHASEELDAMIICGNGTDTKTLEEANIEEADVFVATTGNDESNLLSCILVKEYTNGKIIARVSNPDHEEAFKKVGIDKVISPERTAAGFLEKVITRPNVADLMAFGAGNAEILDMTIQNPKVFGKKVSEFSPTKDYIIISKNNDNHELEIPQPDDILSNGDKISILVKRNAFEKAEKKFMGAGGLFGF

SEQ ID NO: 7436 - protein, 215 aa, Methanobrevibacter ruminantium
MEKIKNVYCIEGLMADSNSYLIDNNDGDGDYNYILVDTGTGQSNAFLFSQLGEIGVKPEDIDLIVNTHCHFDHVGGNDFFPNAKIAIHKKDAVALRDPDSELTVSSLFGAIVRKHDVDIELEEGDKIANFDVILTPGHTSGGISLWDGEILICGDTIFANGGVGRMDIGGSPIDMKDSLMRLKEFDVEYLLPGHGPWVKNGKEHVKMSCLNMGIR

SEQ ID NO: 7437 - protein, 112 aa, Methanobrevibacter ruminantium
MRAPASGGATKKPLPDVVAGNGKIYLAIEVKTTTKDKIYIDHPQIDALIEFSDIFGATPYLGMKFKYTKWLFLAPENILKTKNGNYKIEKDYCLEKALELDEICGFDTQVKF

SEQ ID NO: 7438 - protein, 343 aa, Methanobrevibacter ruminantium
MNFLNENHYRDSMNEIDSIETLELINKANSLSLKKGYTEISLERAVFLSWWCDKGDCKFCYMSTQKDKIKDPKKARRRVNNILAEAEMCSRLGWNIEFLSGGYKSFTTSEIKSIAENIHSITGDGVWLNTGITDELEEYGKEIKGITGAVEAANPEFQREVCPSKPLNQISNMLDKAGDLGFKKAITIILGLGESLEDVEYLKDYIKEHKIDRVIFYSLNPHPETIYVNSSQPASLYYANVVSSIRLAFPDIEIICGTWIDNLANIGILILSGANGITKFPLFKMFGTKYGKRVEEEVKWTGRTLKGTFTDKDKLGPEKSQINPEFDQYIKRYIKESLKNKYQ

SEQ ID NO: 7439 - protein, 451 aa, Methanobrevibacter ruminantium
MMCGLEIHVQLETDSKLFCNCPTNYQEAPANTNVCPVCLNQPGAKPFPTNEKAIENALMISLMLNCKIDKNFTYFMRKHYDYPDLPCGYQKTSVPIGYEGELNGVRIREIHMEEDPGQYKPDRGIVDFNRSGIPLIEIVTEPDMHSPEEARNFLKELIRVLQYSGGARGEGTMRADVNVSINGGNRVEMKNINSIKGAYKALNFEVIRQKNLMKRGVEVKQETRAYLESQMITVSMRMKEDADDYRFIPDPDLPPMKISDEQIDKVLDIMPEAPHNKVKRFVTDYGIDEESAKVLTSELDLAQCYEEVAKEVDPVFAAKWMRDELKRVLTYNKLDFADSGILADDLIELFNMLQNKEITTKAGQRVIEQMPNSKQTPREIAEEMGLIGVVKDDEVLAAAKQALEENPKAVDDYHNGEKASLNFLMGQVMRLTKGKADPRETVKILRDLLEE

SEQ ID NO: 7440 - protein, 283 aa, Methanobrevibacter ruminantium
MEGKTMEQEKAAVRDYMTKNVITVRYDSLNNDVIALMKETKHDGYPVVDEEGHIVGIITAYDLLLKDWETEYVKSIMSQEVIVAREDMHINDASRVMFRHGISRLPVVDKERHVKGIMTNTDIVRSHIERSTPTKVSAFRETMEKLYDIKTTLTREQVPVDKIKPTQDRVYADELQGRTYELEKGLAEPTIVVKTGDRYILVDGHHRAVATVQLGLDKIDSYVVDFNQDITLGMEKTAEKQGLKTFNDITIIDDDQHPLIALTETIKTANQKQKISEITKNKN

SEQ ID NO: 7441 - protein, 95 aa, Methanobrevibacter ruminantium
MDEKILREVYNVLESRRDSPIDSYTSNIMKDSDKKAEDKILEKIAEECGETIIASKNDENLVYESVDLIFHTLLLLVYKGVEFDEILEEFDRRRK

SEQ ID NO: 7442 - protein, 215 aa, Methanobrevibacter ruminantium
MFILIFRDFDPEIHDVYKVAELIYDVDYRTFVHVFKSKEEGVEAIKNRLTFEFAEDREDENELFYLFFDDEDTEEKEIIGMFNGGKGVQHSLFKDILEQFKHLKFSEALGLSKVSFMDNFVLVDVGDDDFYICELAICSNQRGKGYGTEALDQLIQLARDLNCKRVVLDADFRNDGAFRLYSSKGFKVFNKKSFGFPGKKRGMRNMELILDNARE

SEQ ID NO: 7443 - protein, 271 aa, Methanobrevibacter ruminantium
MMKKILKRLAEGEISIEECETLLRAENIRQLDDIANIDISRKDRTGFPEAILADSKDYEDLLAIVKGFFDDEFDLKDNIIITRLSKERYGLLSQDLSYLLDNGIKFDYNPRARILVIYKDKLVDFNPEYGKIGILTAGTSDIPIAEEAKVIVEQGGCEVLSSYDIGVAGIHRLFPKIAYMVEEDVSAFIVCAGMEGALPSVVAGLVDVPVIAVPTSVGYGVGADGKAALYSMLQSCAPGLSVVNIDNGFGAGVYALTIVKNIAKKVKMSKE

SEQ ID NO: 7444 - protein, 815 aa, Methanobrevibacter ruminantium
MESIKVLVEGIVQGVGFRPFVYRIATELELVGYVRNLGNVVEIILQGTDNQLADFIYKLQNELPPIAKINNLRTEDIEIDSPYTDFTIKESSDSFSGTSVIPPDLAICDKCLEEINDPQNRRYKYPFNACTDCGPRFTVIENVPYDRDKTTMDDFPLCDECEIEYKNPLDRRYHAEASCCEVCGPSLKLMKNETEEGISTDKEGNEIKAMKRTAIDTESNDPLKDTARLLDEGKIFAIKGIGGTHLVANVKDEKAVSTLRERLGRKNQAFAVMSPDIETVRTFAIVSDEEEKTLLSKERPIVILKKSKDYDFAESVSPRLHNIGVMLPYAPLHHLLFNETDSPAYIMTSANVPGEPMMITNEEILQNLDEIADYYLIHNRRILNRCDDSVARFRNNELAFIRRSRGYTPEPYDLKGKYTDINPDFDNLNILALGPELDVTFTILKNSKAYVSQHIGNTNKYRTYEFLQEAIKHMMRITKTDSFDAIACDLHPQFFTTRLAKEYAEKYDCPLIPVQHHHAHGISLLNDHYDDNDLNEMIIIAADGVGYGADGNSWGGEILYTDIKGFERMASLMPQKMPGGDLCTKYPARMMASILSNPESDYENEKYTKEYIEELLNNNYLDSFKHGSVEIKSLFRQMETNLNVGINTSTGRVLDSVSTALHICDERSYEGEASMKLESYAFEYKGEGSLDDFPIIVKEYEDENGKRLILDTTAILRYIIDKIEEGEDLHKIAAAGQKAVSIGLAKLAIESAKEKGITTIGATGGVFYNEAITDYIKTYIEKEGFDFIQHINSCPGDGSVSLGQAIVAGTNLNNF

SEQ ID NO: 7445 - protein, 165 aa, Methanobrevibacter ruminantium
MKRKVIMILAILLAVGMTLTAVSAEDSWSFNFSSEENSDGGSINFENGKLTIQGIEFTIPDGYEMDESSKKVAEDAEDFDAKYSACKFTKGDDEIVVNVFFTDGDFENLSANNADQVEKTLNDIKGLYEENKYGDNTPTFTYIEDGKVVKINAPNDEIIESVMGK

SEQ ID NO: 7446 - protein, 171 aa, Methanobrevibacter ruminantium
MENEGQNQQNLNDVDMEAILDVMGCKTRRDIMDLLREEPRFVSEISQELQIGQKAIIEHLRAMEDIGILTSSTKKVVRGRPRKYYDMPNDVNVNITITKNTFNVAISQDMLNANHVPQLPSGDEWSKLLDIEKRIDQGHTEAIEELKSQIRLYDNLKERAEYILERTYNKY

SEQ ID NO: 7447 - protein, 230 aa, Methanobrevibacter ruminantium
MANKKEEEKEEESEDAKKSTKDKIKSKISKSSDDSSSDNEESSSDKEESSKDDEKDKELAKLNEDLEKKDEEIGELKSHIQRLQADFDNFRKQNDKQKQDLIRFANEGLIVKFLDVYEDMERALENSKTEEELREGLELIYSKMKGTLEKEGVEEIPAVGEKFDPFKHEALLTVDSPDHENNEIVDELMKGYTLKGKVIKYSKVRVCKKAKKAEINKAEEAKDDEDKKEE

SEQ ID NO: 7448 - protein, 631 aa, Methanobrevibacter ruminantium
MADAKKEKIIGIDLGTSNSAASVLVGGKPTVIPSAEGASQYGKAFPSYVAFTEDGQQLVGEPARRQAVTNPENTISAIKRKMGTDYKVTIQGKQYTPQEISAKILQKIKKDAESFLGEPVEKAVITVPAYFDDNQRTATKDAGTIAGLDVVRLVNEPTAASLAYGIDKQDDDDDVNILVFDLGGGTLDVTIMEFGGGVFEVQSTSGDTQLGGTDMDNAIMKYLADEFKAETGIDLMNDDQAVQRLREAAEKAKIELSTTLTSEVNLPFISMGADGKPHNLINNLTRAKLEELVDPIVNKCGQPIKQALDDAKMTKNDINKIILVGGPTRMPVVQKFVENYIGKPVERGIDPMECVAMGAAIQGGVLAGEIKDLVLLDVTPLSLGIETLGGVSTTLIERNTTIPAKKSQIFSTAADNQPSVDIHVVQGERKMAADNTTLGRFQLVGIPPAPRGMPQIEVTFDIDANGIINVTAQDKGTGKEQSITITSSTKLSDEEIEKAVKEAEMNAEADKKKQEEIEVRNNADSMIYTAEKTINEEEIKDKVSDEERTNIERLVAELRELISGDDIPAIKDKTDELTKVVQDIGARIYQEAAAAQQAAQGAAGGAGPDPSAGPSNDDDDGTIDAEFEEKD

SEQ ID NO: 7449 - protein, 391 aa, Methanobrevibacter ruminantium
MRKLAEKRDYYEVLGVDRTADEKEIKKAYRKLARKYHPDVAEEDKKEEATEKFKEISEAYAVLSDEEKRQRYDQFGHAGMDGFSNEDIFRNVNFEDIFQGFGGGGGFEDIFDILFGGSSRSRHYNAGPRRGGDIYTETTITLEEAASGVEKDIKIRHDVLCPECGGSRAEPGSEVETCPVCGGTGQRKQIRQSLFGQVMNVVQCGECKGTGKIIKEPCHNCKGKGTVKEDKTISVKIPAGVETGNRLRVSGEGHAGDLGGGNGDLYVEINVKPHKDFERDGANLYYEKQISFVQASLGDTVDIPTIDGAVELKIPAGTQSGTVFRLKEKGMPQMRRSTKGNLYVTITVVVPQKLNKEQQKLLRKFAQISGDEISVYKKGIFDKVRDAINNP

SEQ ID NO: 7450 - protein, 256 aa, Methanobrevibacter ruminantium
MKLMMYSIKMRSAKGGPHEEGGKHISGAERILREDEIEEELINVYRRAITHEKGKPDFINLKIEAIDEDKILYKKRLNIIQHKVSSKEEGLKLAKELLIKNTVSEEAAKEGISSIQKLKESIHGAMLLDKDSGKRIDDKGIKGVRVTGIASADIKKYKESLKRDGREGLHLEEALILASKIASCKAIVAELCWSDDPSYVIGYVGTKENYHRIPILKDKGNPVGGRVFFVDTSQLNDNYTLEDLIDYLEKQIVLIE

SEQ ID NO: 7451 - protein, 414 aa, Methanobrevibacter ruminantium
MNPNLEMKLKEELEELKNNNLNRTIDDLRFISSTKAIDKDGKEFLVFGTNNYLGLTHQPDVINASKKASTYGTGSTGSRLTTGASFEARELEENLSKFKSTESTLIFNTGYMANLGIIYTLTKEDDIIFSDQLNHASIIDGTRISKAKVRVYKHKDTKDLENLIQTEIKELKEKNINSSNFFIVTDGVFSMDGDIAPLPELVEIANKYNCCLIIDDAHATGVIGKTGKGTVEYYKDKTGIDLTESVDLQIGTLSKALASEGGFVCGKKTYIDYLINKSRPFIFSTALSPSTIASANAALNLLKKNSNEYLTKLQNNTKLMRNLLKEGGLNVIDGETPIIPIIIGPADLTNKFSKELEKEGILVSAIRPPSVPKGESRLRLTVIATHTKEEITFTAKTIIKIWNDLKKKLEYENH

SEQ ID NO: 7452 - protein, 241 aa, Methanobrevibacter ruminantium
MFCGEKMDTISMLWQFGILAAVLVFGIKLGLAVGLANLSKKYLATVCIGYGAGVLILAQISSYFATEITELIYTYNSLFFIIMAVIMILAGIFTIREWKVFEKNTTAATCAAVIAPCPCCFGSIIVSILLVAPTVGLGAVDLSVYVAAALVLTIIVTYFASSIFVRYVDKPYPIVLGNFMFFLGIYFLLSALVIPNIAAIMNKSMGSISIVSMESLAGSIVALVLLVVIGIVFSRKNNILS

SEQ ID NO: 7453 - protein, 1805 aa, Methanobrevibacter ruminantium
MKTNYKIILISIILLGLVMSFGAVSAADLNTVQSGEVSGGVDIASSNPGVENGELTYEIPDSVENIQYAGLFVDSYTAGSSNLVYGSEANITLTKNGESEQIASERLVASVGSADGEVYVINDHTTKCFADYMMTYNLTDRLQDAKGNITITVNATPIEGYTFYNKIKLIGLVFTYDDGDGDQFHYWVNAGSSWVKTDSGETSKATFKLGNVNYDPTVATLDNFALSSQDGVYTFNGKEMDESIVTETGVYYYIHHKFDILDKIKNMTNTLVYTPGEGSYSFRNVLSVVKLVKTVPVYAKVNISSEYDDIVFSGTENLLKVGITNNGTGSASYLLDLYADGKKVNSSQISLAAGREAVISLIDNTIRPSAADTVSGADNKKINYTVVVSDKNTGEVLDESSIFPNLLYNGYLGKGLAYPAEKISSFKNITVNGGMIIESLGDSTYLDASMTGKTDSWTIDLPDGAFFTDAFVYVPYNLDNGNVPMFTSTFNGAAVNPIASYRDQPNIGENAKNGYGLLVYDVGELIKAGVNSFALSKEAGIAGVYPSTLIAFYNLTDSDLLTSAFIFNGADLLSNEYNSLGRDVSSDNILSIGAFDGLVSAKLHVFAADCQAGEGDLTVNGKSYKNVWAGTNRSVGDYVVDLGKSTNASNEVSFISTASNILALQQLAVVQYNVPSVKASLVSEYSNAVFAGTNNVLSLNITNNGKFDSIYTVDFYVDGKKQNSTEISLKSGANKGLYLIDDTIRPIDASTVNGADNPKVNYTVVIIDKEKSMVLDEITITPSLLYNGNLGKDLAYPAENITSFRNITVSGGVIVDTLDDSTYINSQATNRTDIWNVNVADGDVFTDAFVYVPYNWDKTNGYMPVWNARFNGVAVSPLVSYRDQSNIGFFGKNGYGLVVYDVSKLIKSGENTFTLEKEAGITAVYPSTLMAFYNATSSNSLKTIYIYNGADLLANENNFLNRTVASDSHLDISSFKEVISAKLYVFSAGAQKGEGNIIFNNKTYKDVWNGTVNSVDSFIIDLGKSPSVSNDVSFVSTGSTIMALQQLIVLDYYVSSVKANVSSEYSGAVFAGTDNVLKVDLTNDGQGGSVYVLDFYIDGKIVNSTEIPLDAGKSTEIFLVDDKIRPVDASTVNGANNAKVNYTITVTDKASGLVLYEASLNPIVLYNGNLGKDLAYPAENISFFDAITVNGGVIIDTLDDSTYLGAKTTGRTDVWKVEIPKDGKIVDGFVYVSYNWDKTNGSMPIWNVSFNGVSVSPVAHYRDQSNMGTYGKYGYGLVVYDVGELIKSAENKFTLEKENGTTAVYPSTLLAFYNRTESNNRTTVYMYNGADLLSNANNFLGRTVASNAALDLALNPNDEIKSSRLYVFAASGQSGEGKLIVNNKTFNNVYNGSANSVDAYIIDLGKSPSASNNVSFIATGSTILALQQFVVVDAIHQSSEELQKMINSARAGSTLNLGSNVFKDVSNVIINKDLTITGGTIYAREGETIFVVTDRSAGGPKEVNITGVKFVLDNANTILQARAVNGSTPTSIDVASINIKKNNISFVDDDVVPESITVLDLKSQRSSIAPTRNLTISGNNLIAGICPFMFEVTSFNGKDSVVVPEGGNIPDKKASVIHYEDMVTTAINTNIEGRVGKYFEVNLTDSNGNPLKDKKVQIGFNGVVYDRTTNATGGVKLQINLGYKGTYTFAIAFLGDDYYNGSFVVAKIKVNTQKTKISTSSKTYKASAKTKAISATLKDASSNPISGKKLSFTVNGKTYSATTNSKGTATVNVSLSKKGTYSFTVKYAGDDMYAGATSSSKVVIK

SEQ ID NO: 7454 - protein, 3451 aa, Methanobrevibacter ruminantium
MKNRKFLIVSLILIVLMLALGSAYAADLSPVTNGTVSGGVDVATANPYASQTGGQEIQSGELSYDVPEDVSDVQYAGLFVNVYGGSAQGDYGAQSNVSITSNGETSQIASESLNYTDGSGDGTVYIVNDHITKVYSDYQMIYNITDRVQGATGQIKINVTNTKLEGYANFDGRIKLIGLVFAYNDGSNNRFDYWVDSGQAWSNSADSVTKANFTVGTVSPFLSANIRNIALSSTDGNYSFNKQELTGGELISDSMFKYHKWDVTDLLKNKTNNLTFNSTKSFKNVLSVLTVTKNLEEIFVSPDGTGTGTTADDPTTMDKAAPALANNGIIHVLDGTYTQSKRYDIRANYSSIVAVNPGNVIFDGNNSVANIRVYGANVTLDGLTFTHGKGTGGGVYFDSDANGGLVTNCIFKDINNTGAGGAVYISGSKNVMIENCKFINTTSTGTGGGAIYIAGDNATVKECSFENATGKDGGAIRVNSRDFAVVRDSNFTGCVATTGGAISWVGKYGNVTNCTFTDNQATGSSNGGGAIYWQENFGLINNCTFIRNKAQVYGGAVNWAAGKINGTIVNSIFKENSAGRDGGAYYSAAGANEMLIMYCSFEDNEADANGGAMGFRADQCYLLDCNFTSNHAKQNGSAVMLYSNVANFLGIGNCNFVDNSADVLNYSIVNNAGKLKLSENNITTNDLRDGIYTNGSILTDVYLYLIVNETNDAASNVVYADIGDEVPIDVYLVDDNSNLINGIGLSVEINGTNITEFDLDGYTYKTSYTPSEIGTYYVTGNYSKAELSNILTGSIVVGEEPVSAIEIAFRGEYVNTTYAGVENLIAVSLHNTGSLDGNYLVEFYVDGELAGTEESKVNAGYTSDINFIDEKIRDLNESTILGHDNLQANYTVIVKDNETQEVIGESSYFPYVLYNGYLSKKYEYSDEFISSFRNVTFNGGYFINTTGSYSGNSNPGLTDIWTLPALGEGASFAGAYVYVAYTWDKTENGPSDWASSFNDESIPIVAQYRDQSNMGTSGSYGYGLVVYDVSSLIKEGQNKYSLTKGDTAIYPRTLVAFYNVTESSTVKTMYMYNGADLLYYGSYNVLERLVMTDSVLNISTEGNVLGSNLYVFAASAQAGEGNLLVNGEKYEDVWNGTTSSVEEKVFDLGDNPLASNEISFVSTGSTILALQQFVLVEYEAYSADVTIASEYNGACYAGTENALKVNVTNDGLEKANYLIELYADGVRVDYEHVEIDVGESNVLTLIDDTIRPVTEDTVNGADNQKVNYTVYVSAAGSLLAEKTITPTIWYNGYLGKDYAYPNETISYFDTITVNGGVIIETLNDTTYMGATVLNRTDVWELDVPDDVEFADAFIYIGYNWDKTGANIPVLNLTFNGETVAPMESYRDQSNLGSSGKYGYGLIVYDVSGLVEAGENTLLIEKEFNKTAVYPSTLVAFYNQEVPDVITTVYMYHGADLLYNSYNLLGRDVESNSVLEVELVDDLASADLLVFAASAQAGEGNLIVNNETYENVWSGSTNSTNVFGVDILDSLKQSNEVSFVSTGGTILALQQFIVFEYDVTSAKAKVSTEYSNSAYAGTDNVLKLDLTNNGTVDTVYHIDLYADGDLVDSIEAEIDCGENSTLYLIDDTIRPVTENTINGNNNAKVNYTVVISDNATDEILDEITITPVLVYNGYLGKDYAYPNDTIQFFDAITVNGGVIIDTLNDTTYLGTKTTNRTDVWTVDVPNDAEFVEAFVYLAYNWDKTNGTCPVFNTTFNGETVTPIAHYRDQSNLGTSSAKYGYGLLVYDVSEYIAAGENSFELLKDYDVTAVYPSTLVAFYDVEDSPILTTAYMFNGADLLYNAYNFLGRPVESNSVLYIDSVDDIDEATLVVFAASGQAGEGNLIVNGDEYTNVWEGTSNSAAAYMINLTDSIAESNNVSFVSTGGTILALQQFVIVSEYAPYAKADIISEYKGVAFAGTNNVLKVNVTNVAEEDAVFNVTLYADGVEIGSQLIEVGAYGSAIAMFTDEKIRPVTENTVKGADNEKVNYTAVVRDVDDLVEDAEATITPDILYNGNLGKDLAYPAEEITFFDSITVNGGIYIEIQNDSSYLASGATNRTDIWNIEAPEDADFVAGFVYVAYNWDKTSAGIPALNITFNGVSVAPVAHYRDQSNMGTYGKYGYGLLVYDVSDLLEAGDNVFTLTKDANMTAIYPSVLVAGYDQEVSDSMKTIYMFNGADLLSNANNFLGRVVASNSVLDIELPDDVIDCALGIFAASSQKGEGNLIVNGESFEDVWNGSSNSVQACVFNLTDDIEESNTVSFVATGSTILALQQFIFVEYELVSVDAKLGSEYNNVAFAGTDNVLEFNITNDGTIPTAYTIEFYIDGELADTLELELANGESDSLYLVDPTIRPVDETTVNGADNAKVNYTVVITDNSTGDVLDIITITPSVLYNGNLGKDLAYPAGEITFFDVITVNGDIIVIGMNDSTYLGSKTTGRTDVWDLTTNEDIIFAAGYLYVAYNWDKTPAGMPVWNTTFNGVTVTPVAHYRDQSNMGTYGKYGYGLIVYDVSDLIVAGENTFTLEKENGTTAVYPSTLVAFYNMPESSTYVTTYLYNGADLLSNANNFLGRLVASNSTLDIDSFDNIVGADLLVFAASAQAGEGSLVINGDLVADIWNGSSNSVDAYAIDLGKNPKASNEVSFVATGSTILALQQFIVVEYNVPSAEASLVSEYSNVAFAGTNNVLQFNLTNNGALNTSYIVDFYIDGKKVNSTQIALNSGESFGQYFIDDTIRPVDASTVNGAANAKVNYTVLVSDKDTGLILDEVTLTPSVLYNGNLGKDLAHPPEEIVLFDTITVNGDVIIDTLDDSTYLGAKTTGRTDEWNLTVPSDADFEVAYLYVAYNWDKTASGMPEWNTTFNGVNVTPVAHYRDQSNMGTYGKYGYGLYIYDVSDLIKAGLNTFTLGKENGTTAVYPSTLVALYNVNESNVLTTVSLFNGADLLSNANNFLNRTVASNNVLELDFTVFDEILSSQLYVFAASAQAGEGNLIVNNETFTNVWNGTSNSVDAYIVDLGNDPSLSNDVSFVATGSTILALEQFVVVKSKYQTSSDLQKLIDAAEPGSTLDLGDNVFQDVANVVIDKNLTIKGGSIMGKAGETIFVIPAKSANGPDEVNITGVDFIVEDANVIVQATADNGSSPTSIDTPNIRISDNFIDMIDGSVVPESVTVLKLDSERGVLAPTGELKVTDNAIAAGIKPFEFDVTGVSNGSDTNIPEGGNIPAKQASVIHYQDMETTAVNSKIEGRVGKYFEVNLTDTNGNPLANKFVQIGFNGVVYNRTTNETGGVKLQINLGYKGTYTFAISYLGDDYYNGSFVVSKIKVSTQNTKLTTAAKTYKASAKTKTLTATLKSSVYNKPINGKKVTFTVNGKSYSATTNAKGVATVKVSLSTKKTYSFTAKFAGDDMYTKSSVTGKVTIK

SEQ ID NO: 7455 - protein, 309 aa, Methanobrevibacter ruminantium
MVDEIKSYEEAGKIVSKVRSDASKMIENGLPILDLVEFVESEILKSGAGIAFPCNVSINEITAHYTSPAGDTNKMVTGDLVKLDLGAEVNGYIADSAVTIMVPGDNLEELFDEDTLEKNQRIIDASAAGLEAAISTVRAGVKVCDVGRAVEEAIAEYGLNPVRNLTGHSLEHWNLHAGISVPNYDNNDPTILEEGQAVAIEPFATDGEGIVNDCPYAYIFSFMQSKPFRMKNTQRMLNHIEKNYRYLPFSGRWLTESFNERRVNTGLKQLGDAMAIYPYAALKERTGAWVSQKEHTMIVESDGCKITTL

SEQ ID NO: 7456 - protein, 1471 aa, Methanobrevibacter ruminantium
MKVYKMILISLILVILSISCVSANDLTNDAIQGDLSDIDYSFTIDDDLSNSDNSLDVSSDLKENSCLDEIDLDKESNQNTTKILSSNQLDSNLLDSNQLESDQLSSNQLDSSLLNSNQLNLSNTYTVSQSTYSKYFDKNGYVKTSVVAPYDTIDLSGNIISKNFIFTIPCHITSSNNAKLTNCMIKFENMTADGRSSVSNLYIRNSVEWCPGVFLEGSTNVDVYGNDIYCTGANGNPVRVIYSNYSNIFGNKLETYFTGYMNLSWKRAGILLGDSHYNNIFSNDVTIKDSNPIYLTTYGFEKSNHNTIYNNTVRSSAISEDSGLSNPSAWAYGIHLMGDYNIALNNTIHNVYRGIDSEGSFNILAGNIIFNLTGGYFEGNDGTEGGDYGIHASYDNIVANNTIFNSKLTGSAIYLMPNNTAYGNIVYNISGHNGLEFNYYADNCKVYNNIIDVPVESPIYVFGRMNNLLIENNILTSVDSSSILVKKQSNSKYPTDVTIRNNLIMGYSKTFNQSPIDYSQIKSDANIISFNNSIAVYNDTYFNYFAEIGNVRDYSDWIDLNNTINYSDSYNYNALVFVGNFSSITDNITKTDYIIPLKDIVNSRISDVYRNVPYNEYKSMMETLNEIYTDIVFNGPSPVDLRGVDSGGNSSDSNQTPMDGNGSMNESSDNGSDNSTNSSLDNLDDEVKDSYENLIDNINSTENASDVYVINDANYALYFNEDGSFRDDFPIEFGNTLRFANLTNKMFKIDIPLKIISDSEDSSLLNCFISLEGESSNTIISNLKFELDNLSSNIDFISIKDGVSNVLIYNNTFKLDIDSSDSLIDSPLSDDASLSAIRLYGSDYISRNIFIENNIIDFKSNFGQLYGIYLSNKMDYLNSKTNPSGFIIRNNVFSIDSNGLINAIYSDSVKNLLLENNLFNLSSNGNLEDSSLIYGLDLVKVDNLTMINNQFSINSTYLACGINSSDSSGFNLSNNQFSVDSAYLAYGLNLKNTNNFNLHNNDFYIDSGSFAHALDLDDCNNFNIANNLINASGADIKRNLNASNLAVFIQDDLNDNVLKNGYLYISELNGSLKGNGLYENDFKSPIVHTDNSTRDLQNLIDFAVEGDTVELGNMVFADLDTINIYKNLTINGGIFVSGNWRPLFHILPNDELLNHSSSDSYNSYRSFDYLNIQNGAYYLDNADLLILAEACNGTDSLSIQVPSLNICDNEFMLLDDSTVAESINILKLLSSRAILAPTNDISIENNILVSGMNPFVFEVSSIMTGSDIDIAHGPLNPKKASKIIFEDMVTTAFDSNVEGRIGKYFEVTLKDENGNALSNKAIQIGFNGRIYNRTTDENGSASLQINLAYKGTYTFAISFLGDEYYNGSFEVAKITVKKQTPKLDVSNVTYKSSAKSKTWTAKLTTSYGSLLKNKKVYITIDGKTYTTRTNSKGIASLKVSLSTKKTYKFTVKFEGDDTYNSLTKTAKLTIK

SEQ ID NO: 7457 - protein, 294 aa, Methanobrevibacter ruminantium
MNEKNESAFPIRCDPEDEIFVKCMSRIKEFPQYITGYDDIEGPYESRFISSGYRNLNLDSVRIRSDKSSINIEHHSSISQEAMRRNYEYAVNVFNATGQAVYPFIFYTGDLPVDKITYMNQLNYFHPQWFILKEKDGMKRLNNIKYKTDNDIDMHIFEFLDYIWLPKFKLEITIEECIRELVKLYNKLSADEFILNFTKECLALWVGRYIKDQDELKYMARCLNMSKIEERPFEESLRGVIFARKLEEAEEKGVEKNRIDFITKALKQMSPQEVSDLFDIPIDSILSVQNQYSK

SEQ ID NO: 7458 - protein, 281 aa, Methanobrevibacter ruminantium
MAFGTYKDVVSARATDKAIQKVAQDGGIVTALLTYALEENIIEGAIVAGNTEDPWKPEPTIAMTPEEIIAAAGTKYTFSPNAIRLKEAVRQYGLEKIGTVGTPCQIMGLRKMQSYPFATRFVADKLALIIGIFCMENFPRDSLKTFIEGKMNSSLEGVNKMDIGKGKFWITDVEGESGLPLKETHGYEQAGCNICLDYVAELADVSTGSVGSPDGWSTVFTRTDSGADIFTAAVEAGVIETKPMDDVKPGLELLEKLANGKKDKGRKEIERRVNMGLPSPF

SEQ ID NO: 7459 - protein, 319 aa, Methanobrevibacter ruminantium
MLARIKNSIRKFLGLEAKPDAEDDEAKAETQDKLKQEIKKEVEAQSKPAEEAKKEADAKAEEEAQAKKEAESSKALKESSTQEVEKVADKPKIGYIHMSGCTGDGMSLTENYDILSTLLTDMVDIVYGTTLVDLWEMPEMDLALVEGSVCLQDEHSVKELMEVREKAGLVCAFGSCAMTGCFTRYARGGQLAQPKHESFVPISDLVKVDCAIPGCPASPEIIAKVVVALINGDMDYLQPMLDMAACNLACGCDLQTNVVSKALCCGCGTCVLACPTRALEMVEGRPSHNKNRCIKCGACTTHCPRTWFPAEQIKKDLGL

SEQ ID NO: 7460 - protein, 157 aa, Methanobrevibacter ruminantium
MPYDAGRLVVGCGNVLFKDDGFGPMVIHALEDYFKENNLEMPKDTQFIDAGTGATHFIFSMPDDNWKKVIVVDVVEWNAEPGTLKIFSPYDMPKGKYENAHTWPVEEPLHDLVDMGIEVVIVGCKPKEITAPDVDMGLTEPVEAAIPKAIEMILNEL

SEQ ID NO: 7461 - protein, 385 aa, Methanobrevibacter ruminantium
MEIDDEGIVTKGRYFSITPVRGLEKMVTGKAPETAPVLCQRICGVCPIPHTLASVEAMDDSLDIEIPKAAALLRELTISASNLNSHAIHHFLVAPDFVPEDLFKTAVDSVGTIRKNAQYVVDMVAGEGIHPSDVRIGGMARNISELARKKLYARLKALVPVVDNHVELMTNLILEKDIPEGLGVIDAPVFASDVVYGKRDFFDLDRFTEIVPEAWYDDPEVGKRACTTIPLYDGVNVETGPRARVDKFQGYKERGVVAQHLSRAREMKTYLSRAIAILDELDTAANTLADFDPRGTNKLGIGVIEAPRGTDVHMAQVKDGKTAFYSALVPTTWNIPTMGPATEGFHHEWGPHVIRAYDPCLSCATHVMVVDDEDKSVVENKMVRI

SEQ ID NO: 7462 - protein, 397 aa, Methanobrevibacter ruminantium
MLVNADLHIHSCFSMATSKDMLIENIAPKSLEKGLKLVGTGDAFHPKWLDIIRQSTEYKGDGIYSRGDCDFVLTTEVEGKHKVHHVIIIPDLDIAHELSAKLVSSNKFIDGRPKTPLGGAELLELVREYDCMIGPAHSFTPWTGMYKYYDSIYDCYDKRPDFVELGLSADTDMADCIKELSDFVFLSNSDAHSPWPHRLGREFNQIEMDDVSFSSLKKAFKHKTVKANYGMLPNLGKYHMTACTKCYKLVDPIIAKENKMICSCGGRIKKGVDYRISEIADFSQPKHPSHRPPYVHLMPLGELISMVYDKGVTTKTVQGIWQKMVDNFGPEIDVLIKTPLDEIEKIDSDVSLAIQGFREKTLNITPGGGGKYGEISFSEDFNKTEKKESVTTLDSFF

SEQ ID NO: 7463 - protein, 187 aa, Methanobrevibacter ruminantium
MSKKRCPWAEDVEEIYVKYHDEEWGVPTYDDRELFEMLVLESFQAGLSWITILKKRDNFKEAFDNFDVVKVSEYDDAKVEELRNNAGIIRHKGKINSAINNANVFIEIQNEFKSFSNYIWGFTDNKVLKDTEENYKTNSPLSDKIAKDLKKRGMKFVGTTIIYSYLEAIGVIDNHIHECFKYKEESD

SEQ ID NO: 7464 - protein, 158 aa, Methanobrevibacter ruminantium
MKSSVLLEEIKENIQNYDIDHIKENLKKEDINPISKQVSEFNLKNYDEIMETKISEEDDFEISDEMIYSMKNEIDLFFKGCSPESEDSFKKFIESICLYLSLIAKKPLHPVGMDFKNGNTVHEEIEDGNTVYYCDLKEYFGKQEKDYYTCKFCVCKTV

SEQ ID NO: 7465 - protein, 335 aa, Methanobrevibacter ruminantium
MAFKDIFKFKQGETTFIFVGGKGGVGKTSISSATALWLAKQGKKTLIVSTDPAHSLSDSLETKIGHYPVEICENLYAVEIDPDKAMEEKQRALESQKSMATADQLLGLDFLGEQMDLASASPGADEAAAFEVFLSVMTSNEYDVVVFDTAPTGHTLRLLSFPEVMDSWVGKLMKARSKLGAAASALKNIIPFMDAENDIQSSQELEETKKQINEAKAVLSDPDRTTFKMVVIPEEMSIYESERAIEALNKYDITTDSIIVNQVMPDISDCDFCHSRYMLQQKRLALIDQKFSDQVVAQVPLFKDEVKGKEKLLKLAEILYEGKDNDEVEASVIQL

SEQ ID NO: 7466 - protein, 43 aa, Methanobrevibacter ruminantium
MFVEEIPEEKFYSNRIRDEFIEEVVEKIENNILQNKYRKYLDY

SEQ ID NO: 7467 - protein, 49 aa, Methanobrevibacter ruminantium
MFYEERVEDQFSTYRNREEFIRELLDVVDNKITDEEMEDIYQLLDIPRN

SEQ ID NO: 7468 - protein, 253 aa, Methanobrevibacter ruminantium
MTICISAICTENNEEHIVFAVDHMITTGLGQFEHSINKYNVLNENVVGMMAGNALLMDYFFDEDYSENSFSEILDIFEEKFKEKRLNIIEKEILDVYSIDLDFIRDILKGPITNDFQAAILKKIAKTKLESAILLMGFENNKARIAEVSDYGIGNFNRINFHTIGSGSIQAQNTLMFQKHSKKDDLRTTLYNVYKAKKNAEVMQGVGQDTEIGFLNNGSIVMLDKKNMGILDNVYALELNWGKEHKEVGALDF

SEQ ID NO: 7469 - protein, 359 aa, Methanobrevibacter ruminantium
MLEIKHTICPSCSVGCGLNIVSKDGAVVGTYPYKRHPINEGKNCSNGRGSILQFENKINAPSLVQNGELVESDADSIIAAIKKELDAIDASELAIICSDKNTNEEIDAIKKFAEDFGTDKIGFYGYNFPKFSGEIANYNDINNAKFILAIGDIYGENPLAARRIVLAKDKEAKFFNIDDVEKSITALNADEYIQFSDKATFADAIASVKGELNEEAVIVLNKIADAEDFKLVEDLASETGAKLLPILNGPNSKGAMDKIDPLTKDEIIDLIDGSKVLIVVNDNLLDYLSESDIKGKAFIANISNFEDEFTKFSNVVLPGKAWVEKEGTFTNAEGLTQSFAASADLGEGLSEIEIFEKLA

SEQ ID NO: 7470 - protein, 384 aa, Methanobrevibacter ruminantium
MSENLMLAKSKENEITDSGACGGAVSSIFQYLLSQGIVDGVLTLNKGEDVYDGIPRLLTDASEVIETCGSLHCAPTMVGDLISSFLSDQKIAVAVKPCDAKAVNELVKRHRINPENIITIGLNCGGTVRPETAQEMIEKFYEVDPADVVKEEIDKGKFIIEMADGSEKGIKIDDLEDEGYGRRDNCQRCELKVPRNADLACGNWGSEPGWTFVEVNTEKGNEIIEGAKAEGFIETKDPSEKALEMRGKVENIMIKMGKRNTKKQLEDEALTLEEWENQWNKCIKCFACRDVCPICWCHECELEKSYFKDDGQAPPDPLSFHGVRLSHMSPSCVNCGQCDDVCPMEIPVSKLFHKLQVKYEGQTGYVAGVGDEKPPLYSPQKENF

SEQ ID NO: 7471 - protein, 133 aa, Methanobrevibacter ruminantium
MADDIKIVGFCCNWCCYGGADTAGTARMQYPPNIRIIRVMCSGRINPSMVFKAFREGADGVFVGGCHIGDCHYDAGNYKWNRRALMTKDIIEEFGIDKERFRFEWISASEGEKFQRTMKEFYNTISQLGPRNK

SEQ ID NO: 7472 - protein, 957 aa, Methanobrevibacter ruminantium
MTNNEIEKKWQKKWADAKLFQSDPNEKEKLFLTVAYPYPSGAMHIGHGRTYTVPDVFARFKRMEGYNVLFPMAWHVTGAPVIGIADRIKRKDPWTLDLYERVHKVPHDTLPSLEDPINIVKYFSNEYHTVMDDMGYSIDWRREFRTIDPTYKKFITWQAKKLKSLGLIKQGEHPVKYCPHDENPVGDHDLLEGEGVGVNELTLIKFEVEPGLYIVPATFRPETIFAATNVWLNPEVHYIEVEVKTGANAREKWIISNEAFLNLSNQHDLEIVGDIDPKPLIGKYVKNPLNGEPLPIFPASFVDPEYGSGTVFSVPAHAPADYIALRDLKENEELIKDFDIKEEVAKAEPLNVVTVEGYGEFPAVEVVERMGIENQNDPKVQDATDELYKAEHSKGYISDHIEKYAGKRVAFIRDEIKADMIEAGSADIMYDFAERPVICRCGNKCVVKVMDDQWFIRYGDEEWTEKTQKVLAQETIIPEEIRSNFEYYLDWLDDWACSRRVGLGTRVPWDDQWLIEPLSDSTMYMSYYTIAKYLKDMDPEDLNEAFFEKVFLGVDSDEITVPEETVNQIQEEFNYWYPLDWRLSAKDLVGNHLSFLMFTHAAIYPEEKWPKGTVVFGMGLLEGNKMSSSKGNVILLADAIEQYSADVVRLFLMASAEPWQDFDWREKEVRGTQRRLEWFREFAQKVEDIKGEKLDLSNIEEVPLERSIDKWMINQLNIHIKEATEALEVFQTRQALQHALFLLKKDLDHYLYRVQDLIEAKDPAVIYVLSTLLSNWIRLLAPFTPHTSEELWSKYGGEGFVSFAKWPEYNEDLISKEIERSESLVQNIVKDINEIKNIVDTDPEKIHLYLAPEWKWELYKIADEVGKPDIGQIMGKAIKADIYDNKKEIANVAKRISKEMIKTRYIGKIDEETILNDAKDFIESEVGSEIVIHTDDSYDPQNKARNAMPYKPAIFME

SEQ ID NO: 7473 - protein, 457 aa, Methanobrevibacter ruminantium
MKKNKLEKGCEKMSADDKKLDQIIKTIEANDIKFLRLELADIHGLPKSMAVPLKNANDVEDIVNDGLLFDGSSVAGLASINDSDLLAKPDINTFSTIPWRPESKGTSRFICDIYTTEGTPYDGDPRGILKKTLEKAEKRGYQYNVGPEPEFFIIKKDENGNYVPADEAEYFDVEPLDQGTDIRREIVFGLEELGFDVEVSHHEVAAGQHEVDFKYADALKTADAVITFKEAVKAVANNLGVKATFMPKPFIGINGSGMHCNQSLFKDGENIFYDPNTETQVSQEALYFIGGLLKHAQALSAILSPTVNSYKRLVPGYEAPCYIAYGFKNRSTLLRIPASRGLGTRIECRSADPSCNPYLAFSALLEAGLDGMDNKLDPGEPTEENLFAFSEEEIAEKGISNLPTSLWEAYHALEEDDVIIGALGDKVFNQFYNIKRAEWDAYRIQVFDYERDEYLNV

SEQ ID NO: 7474 - protein, 305 aa, Methanobrevibacter ruminantium
MCGIAGVIYKDKKTHPVGEALTSMLESLQHRGPDSAGYAIYGSLDFPENYYQLNIEVKRRRGALDNLKSLLNQISPIYEEEIIKSVGDSDVYKCKIALDEFSLLQPWIREIDELENVRVINGSHSFEMIKDVGKVKDIAERFDVQSRMGTHGIGHTRFATESGVDRYHAHPYQSYIIPDITVVHNGQITNYWKIRDPLERKGHTFESFNDTECIVHYMADKLNQGYKLEEALDQAVIDLDGPFSILVGTPNGIGIAKDKLGLRPGVMVETDEVFAIASEEMALHDVTDSNEIEQIAPGETRAYTI

SEQ ID NO: 7475 - protein, 215 aa, Methanobrevibacter ruminantium
MKEYIINAKDMEEKELNRAIKEQAAHHDKLIINNPESRHNICAGLSEDVDIEINGSAGYFVGTMVNGPKIHINGNAGWFAGDNMTKGELIIEGTAGDGAGQGIYGGTVIVKGSTGSRTGEIMKGGTVIIGGNSGFMTGLLMMGGKLIILGDVTDDVGESIMRGSIYVLGEVKSLGKNAIMEETTDEDLKDLEETLTKYGFEDIDYSNFKKIVNIQ

SEQ ID NO: 7476 - protein, 364 aa, Methanobrevibacter ruminantium
MSEHKIAMVGTPCEIMAASKLQDYTDSPIEVKLGLFCMENFSYKYFVNFLKEYDLKMDDIEKFQIDKGFLFLILKTKETVKIPLSVAKRIIRKNCNICVELTSETSDISIGSIGSDDGWSTLIVRSEKGEEIVKGAIEQRFIEVEELEESKFQLLNKLAQGKINRNLEHIEQREFLARPVLYQREKDDDSISKEISESDFSDLKSNVIDIGACVLCGACEYACPDNLIIIDDTKPRMKGQCPPDCHACFAVCPRTFIEEHLRNDNEKPIGDYINVYTVRSLKHSQGQDGSIVTTILDYLLSNEIVTEALIVDKKDDLAWKPYAKLTKDIDQVVKSGGTKYSVCPVFKPLKEINEESSTTEEGVN

SEQ ID NO: 7477 - protein, 495 aa, Methanobrevibacter ruminantium
MSFTVERKIEICRQNNDRPGCCWYLCDNPNKSACKNCYSCYSNCPHGVYEVINDEPLPIHQENCVGCKICEEMCPTHAIYVRPLVDEGRGIWSNSTMVEIKRKSQTGSYKVRGCGLTRRIPSFDDLSILPAQVSRPPIDSYRETCKTSVVLGDRFAENPIEIDTPIMIGAMSFGALSKEAKIALAIGSSKVGSITNTGEGGMLPEERHYADKLIAQYASGRFGVSASYLNNAEAVEIKIGQGAKSGMGGHLLAHKVTAEVARVRNIPEGTSALSPARHMDIVGPEDLGMKINQLREITDWKVPIIVKFASGRVEQDVKIAAKAGADIIVVDGMQGGTGAGPEVVTEHAGIPTIEAIVKADDALKEINLRSEVSLVAAGGIRSGADVAKAIALGADAVYVATSALISIGCKVCQSCSEGICPKGIATQDRALRRRLDPIRKGQQVANYIEAMTQEVTSLTQQAGNTDIENLERQDLVALTMEASQLTGVPMVSQRY

SEQ ID NO: 7478 - protein, 880 aa, Methanobrevibacter ruminantium
MAAFDRIKSGIPGLDSALDNIRLGDNVVWNVTNLNEFSYFVNPYIKQAKEDNRNLIYIRFANHPPLIEMTEEDFRLLEIEQNNPETEFSMIERDGIKIYLVNPYNQFETFTLEVHRIIEKEGFDAFYVFDCLSDLQAVWSTDLMMGNFFKVTCPFLFQLDTVAYFPIIRGRHSYDAIAKIRETTQLFLNVYSNSPEEVYVSPLKVWNRYSQTMFLGHKFNPRTGFVKVLQDGQEVSKYYKTINSDKYMNGQTLDSWERYMLKVRREYEEGKNIDEECDKICELMMTKDEKMLSKIKEYFSFEDYTTIYDRRVGSGLVGGKSCGMLLARKIIERNCPEIYNNIFEPDDSFYIGSDLFYTYIVSNDLWDLRVKQRTPEGYYKYGKELEEALKNGSFSDQTKREFIKMLDYFGQNPIIVRSSSFLEDGYGNAFAGKYESVFCVNRGSLEERLAAFEEAVKVVYSSTMNISALEYRKINGLDDTDEQMALLVQRVSGSYHGDYFFPTAAGVGFSYSPYSPLPDMDNSKGMLRLVMGLGTKAVDRTKKDYPRIINLDKPEVTMAKDIKEKHRYSQHYLDVIDLKEISLHDIPVDEGLSVIPRYSKNMLVEHDREAERMFRDRGQRREIVFVNCEGIVKNDAFIETMKEIMSTLQTAYDYPVDIEYTVNVGEDKSFNINLLQCRPLQVMVNNEAIEMPEDKNVFFHIKESSMGMSRKNTIDTICYVDPHKYYEYPYAQKSSISRVISDVNAYLKSNNKTAILIVPGRIGTSSPELGIPVVFADISYFSAILEESYSDAGYMPELSFGSHMFQDLVEADIYYGALFENEKKLEFNKDMVYDYPNILKDINPNLSEEIYDMIQVIDFDENKAELYHDMNKDETLCIFK

SEQ ID NO: 7479 - protein, 451 aa, Methanobrevibacter ruminantium
MNKSKKCAEKDLAHIWHPASQMKDYEDFPPIVIDHAKGVHLYDVDGKEYTDIISSWWCNILGHCNEEVSQALKDQLDELDHVLFANFSHKTIIELSERLIKVMPKGLNRFSFVDNGSASVECALKMAFQYCAQTGRAQKKRFMCFTDAYHGETLGALSVGALDEYSSVFEPIMIDTIKIEAPDCYRCPYGKTRNDCDCQCFEHAERAFEEHGHETCAMIIEPLIQGSAGMKIYPPLYLKKLRELCDKHDVLLIADEIATGFGRTGKFFAVDHANITPDIMCVSKGLTNGYMAMAVACTTDEIYNAFYGDYEDNIAFMHSHTYAGNPLAASVANATLKIMERDRIIENNQEKAIWLNKRFHNTFDEHPNVGEIRQMGLINAIELVEDKESKKGFDSSLRIGYKIYREALKDGLMLRPLGNVMYFNPPLVITKEELDESLAICKKAIDKVLLD

SEQ ID NO: 7480 - protein, 532 aa, Methanobrevibacter ruminantium
MTKFIFLIILLKFMRKEILIAAIAIILILCGGVFAASNMQIADIATFSLNAIDLEDRGSLIVDSEDITASKGYYNSSASDENVVLVKNYSLRLSNSIVNKTGDTGSSGDDADFYGINSAVLVNSNGSVELSDVEIETNSKGSNGVFVTNAVSDSNSNSSSSSGSPIVDSTERHDGKSDAEEPGGVPPEKPVEDGPSVYGGSSGGKGALSDGNQSMPAPGASSSDVEGSSSADISNVRITTHGDKSRGLDATFGGKIIASDVEINTDGQSCAALATDRGEGEVHVKNCILNTGVDEKSGRGSPIIYSTGNITADNSEGCAHVSQIACIEGKNSIALSNCEFSAGAGGNREDNGEYVDLGGVFIYQSMSGDADVGTSLFDANCCVLSIEEDSEYYKTAPMFHVTNTKAIVKLASTELNFGSGVLLNVSGQSQWGTVGSNGGELEFDASDEILDGDVFVDSISSLNMSLASTSFIGAVNPDDDFGETNLVIDSDSDWTLDGDSHLSSLENNGDIDYNGHTLYVDGKAYTESNPFK

SEQ ID NO: 7481 - protein, 232 aa, Methanobrevibacter ruminantium
MSKGLFVLGTGTDVGKTYVTGLLLKYIRDNGYNASYFKAALSGAIRDNEGKLIPGDAVEVINMAGLEEDTDFLVPYIYETAVSPHLASQIEGNPVELDKVKHAYEEVSKKYDYIVMEGSGGIVCPIRYDGQGCKSNILLEDIIKCLDLNVLLVADAGLGTINSVITTVDYLKNRDIQVCGILLNNFKDMPMENDNLKMIEELGGVDVIAKIYKNDKNLSLDVQLDVLMNYFK

SEQ ID NO: 7482 - protein, 326 aa, Methanobrevibacter ruminantium
MYNIIELKDKVLNNYKVTKEDALNLLDVPLDELSDAANEIREFFCSNKFDVCTLINVKNGRCSEDCKFCAQSNHYDTDIDIYPFLSKEELVGKSNSLLDAGFKRISYVASGRKIRDKEFDIVVSALEQLNKDRTDEFHLCLSLGLLSEEQISTLKNLNVERIHNNLESSRDYFSNICTTHSYDEKLDTIDLIKDKNLMVCSGGIFGMGESFEDRIDLAIQLRDLGVKSIPINVLNPIKGTPVENNKILSNDEVCRLIAIFRFINPDAFIRMAGGRTLLGDNGRKAFQSGANAAILGNMLTTSGVELEEDFKLLEELGFEITYSIDA

SEQ ID NO: 7483 - protein, 237 aa, Methanobrevibacter ruminantium
MDERGKKYLLKEDREFQTDLGIIKKEQMERATIGDTIITHLDKEFKVIKPTVNDFIDLMERRCSILIQKDIGTVLARTGLGAGDRVIDAGTGAGAIALNFGNVVGDKGQVYTYEIREDFAEIAKRNIDNFGIKNIEVKNQDIKEGIDEEEIDLVFLDLPKPFEIFEDVKKALRLGGWLAVYAPYIDQAEVAYRIAKKLDFRDLTILETLEREMEIRPQGTRPKTRMVGHSGYLVFCS

SEQ ID NO: 7484 - protein, 842 aa, Methanobrevibacter ruminantium
MVTYIEHPLIRPNAAEARIYQQVLAANVLKNGNTMIVAPTALGKTIIAILVAADRLQKLKGSKVLILAPSKPLAIQHEENFKHFLNLPCTSITGAVKTDEREKRWDASSIICATPQTIESDLLNERYTLDDVSLLVFDECHHAVGSYSYVYLAHRYVKESNNHLILGLTASPGHDKSKIKEVCENLFIQDITIKTEDDPDVKPYFNPIQIDWVRVQLGEELEKIRDLVNKALKVRLKGLKSLGVINTVSVTKRDVLKARSRVQRKIGQSVNPPKECFQAISILSAVINLQHSLELLETQGVVPFNDYIKRLRKKTTKAAKNILLDPNFSKAIYFAKEAEEKGLEHPKMNKLVELLKLELGVDEAQTRLTSLRNDSDSSMDEKVKEDSPKIIVFTQFRDTLDMIHERCEREGIKSVRFFGQGTSDGKKGLTQKEQKKIIKSFKTGNYDVLISTSVAEEGIDIPAVDLVIMYEPVPSEVRMIQRRGRTGRKSSGRMKVLITEKTRDEGYYWTSMRREDKMKTQLATQEAIEELKLNAVEKIEVEKSAKDLGKREKVIIEDPRDDDSSDNFEEEAKNEDIEEISLENDNEEKQKELMEKEAKKKQSLEDSIIEELAKSSTSDELVVYVDSREGNSRVIRALDTIGVKVKVNTMAVADYQVSDDVAIERKTASDFVDSIVDKRLFKQAKAMMEEFKKPILILEGDDFYTGFINPNAIRGSMASIAIDYGISIIPTRTPEDTAAMIKRIAIREQQGEKKSIQIRTERKPQNLWEQQLFIIESLPNIGPVHAKNLLEHFGSVKAVLQADEKQLQEVDGIGKKTAKSIKEVVDGKYLYFKKPEKNEKLI

SEQ ID NO: 7485 - protein, 5066 aa, Methanobrevibacter ruminantium
MKFEKISMLISIVLISLIALGAVSAADDVAADDAVAPATVDEVQTIDNTITNDDISYESTDIIVNDTGDSADSKAKTTSLSANAVNEGETLSFTQLAADVSSSPSMLSGAYYKYDPSTDTAFENGITLTNGLTIIGGGATIDGDNQARIFNIPEGVSVTIMGVTLINGAADEGAAIYNSGKLTLMNAKVNDNTAVKSGGGIYNNGGEVLVTSSEFDGNDLTDRTVNGYGGAAIYSNGGSVTITDTNVTNNLKNIVHRGGTGTYTGDLSSAAVTSNNADLTVTNSRFIANSGSYGGAIYSGESTSANLLVSGSTFEDNFAFNGGAIDIVGTSYTISDSTFKNNNVKGTGSTNSNYASGGAICVQDANNPGLISGCDFEANSGVVGGAVNCENTMVLDCTFTDNTANSANSETFNGKTNNRGGFAGAIYNEGTITISDCEFDDNAGRGEGIRVKNAEISDSSFTNTRIDTCQNSNVLLTNNTYNNPDRDVQAASGTQVTVDVADGDIPNANTAPYIVGDLTFTDLQALIDSGSSGIRLTGNVIKTAEEETTFADGLNVDKTVTIYGAEGKVIQANSGKIFNVAEGKTLTLRNATLQGSGETAITNYGTVYLYLADNNQFTDCGDVLIDNHGRTTETGLTTFTQLNNLIGLVNGGTVYIGESKITKAEDEKEAYKNGIVIDKDLSILGSYNTYYKYVKTSINANNDGRIFTVAEGKSLSLKYINVTNGAADEGAGVYVSEDATLIADTANFIKNTAVTKGGAIYSEGTVDLTNVNIKNNTISKTDGVMADDNGGAALYNNGGTATLDKVNVTDNQKTYVIGDIMDGVVVSKGATTITNSYFANNSGRWGGAITQTGTDQTLTVEDTIFEENTAIFGAAIFDNSPLVVKDCKFYNNSAIGPGSPGTSNSQGAAILVMDDTASADISGSEFINNTADCGGAVSLAGVGSDSSIDDCTFIDNTAYADGGAVYFWTESASVTVTDSEFISNTAPYGGAIENEGLGDLIVDGCEFTENTASLRGGAIISSGDTSVSNSKFTDNEASGNTNAIYLYNSGSSLSLSNNVITGSDDAQIYVKEGIDVVTPLKVKILNNETVNINMVPYDITATVTDDKGNNIVDLAFRFTVGDDVVDGISIDAATGVYTATFTPTQAGEFVVSTNLANADEVQTGTLNVFRTLTDLKAIIDANTNGTIDLDGNYAYNAEFDSALTDGIVINKDIVINGNGFTICGENSTRLFHVTSGFLTLKNATVCHGAAEKGAGVYVDHGSKLSTDYVTFTENTAVKRGGAIYSEGMVYIGNSVLDSNNITFRSANDDNGGAAVYNLNGQLTIEKSNITNNLKDIVIRNGNAGDLLVGVVVTTGDTLIKDSYFANNTGSWGGAISSLGYMNTDDYTLTVKGTTFEGNNATFGGAIFVESSNLVVDDCIFNENTGVGKGSDGTSNTQGGAIVVHPTGSKATITNSKFNKNSANTGGAVSLAGVGQDSLIEGCTFTDNTANDGGAVYLWTGGNAIVTVKDSSFSDNTANFGSAISSDGTLSLSHNEIANDYTITPIGSYDGTIVSAIYVTTLNGETIITGNPTQNLTATITDDNGNPIVEKGLVLEVYGEEVETSYDKTTGIHSAIHTFTKPNSYRITAKGFDQDHTTPGYIVYTGGTFNELQDLINAAEEGATITLDHSIVYDEEFDGVPFLDGITVNKTVTIVGAEGVEICANNLARVFKVTDGATLTLKDATVCHGTAQKGAGVYVDAGASLIADNVTFTKNTAVKRGGAIYSEGMVYIGNSVLDSNNITFRSANDDNGGAAVYNLNGQLTIEKSNITNNLKDIVIRNGNAGDLLVGVVVTSGETLITDSYFANNTGSWGGAISSLGYMNNEDYTLTVIGTTFEGNNATFGGAIFVESSNLVVDDCTFNENAGVGKGSPGSASTQGGAIVVFPSGTKATITDSRFNKNSANTGGAVSLAGVDQDSLIEGCTFTENTGNDGGAVYLWTQGDATVTVKDSTFTGNTAGWGNAISTDGALKLEGNTISSTSADVGNWAGTIDSKVYAQILANDTYNWHMGGFVINATLTDDMGNLINDHNFNYVITKEGATDSISVPATFYTSLGYYQGTFTPADIGTYLISLDYAVEEVNTSVVVVSRSLIDLANIIAADEDGIIDLDDSYTYIEEFDSSIVDGIVIGKDVTINGNGHTICGDDKARLFHVTDKALTLNNVTLCHGNALNGGAVYVESAATLNANNAEFNENTATYRGGAIWSTGTVNVKDSSFDNNNITYRARNVDNGGAAIFNNGTLNVDHSNFTNDLVGYVVRTGDTNSPQLIDGIILSSGVAVINNSHFENNSGTYGGAITAVPIASLGSTATSLTVENCEFINNLAYCGAGISINADGNGKTTYSIKNSTFIGNNATGVGSTGSTSAGGAISIARDSEGTITDSKFYNNTATTGGAIDVSATRSSSKVTIDNCDFENNTATAGDGGAVRISKNNLEVAVKNSNFTNNDATGDGAAIYNNGVLTLEGNKVTSGETEIYVGPNGSVVNSIVKAIFLGDAEDNTILAFLGDEVHPYATLTDDNGNAIYDVDFNITVDGVEYETSYDDSTQQYTATYTILHAGDNIVSTNYDAQKTDGKYDVPKANATIVVTTESISVGDKATVNINLTGTDGVGLNGTVKITINKAFTDTVVTENGINVTEVEGLEIGEYFVYVYFEGNSDYNPEYNYTLFRVTGNVSYFNVTIEDVTYDDAATIKVTVQDGPIDDPDNGVTGIVLVTIQGKDVNFENTYSVSVIAGEGSYTVEGLAPGNYSYAAKLLADELYNEAYLEPQNFTVFENPYSELEVTDDGPIASGETVNITATLTDFQGNPIEGATLEVYDTGVWIANITTNAEGIAETSIDNLGYGLHDITVIFNDTVHDVQTETVTVSVTPKKGTFTDLQYLIDTADGRLVLPYDFAFDAAYDEQFFLTGVLVDDNIIISGAGHIIDGMKKARILYINAPNVKIFNVSFVNGKSDVGAAIYTEADYLLVDSCYFANNDPEAGAAIYAESGVTDVEETIFFNNTAVNGGAIYVESGATLNVADSEFNQNTATYRGGAIWSNGTVNVKDSSFDKNDITYRVKNDDNGGAAIFNNGTLNVVNSRFTNNLLNYVIRTGDDNHPELVDGVILSSGKAKISNSHFENNSGTYGSAITALPIGTELSDLTVENCEFITNLAYCGAAIYVGSGTTLFYINDCVFIGNNATGVGSNGYVATGGAIKIAKKATGIIADSQFYNNSAANGGAIDISATSGNTASVLIDSCVFGYNVADQGGAIYIDNRTTVNLYDSTLYYNEGEALNYHIFLNGDATLGFEGNNFYTTIPTIVAEDTYAYGETITINGTFDWGVNNKPINMIYTINGAPGTAEVVDGNYTILIDNQPDVGDYTIVITAFTDENGNVYHVETAQKTISVTKATPILSVEGDEYLMPPSDDATVTISLTDKDGNGIKGTVIVTVAGETYLVETDEDGDGELTINDLPATTWAIDAKFIGNDNYNEVVNDTEEITFIADVAYFDIIIEDGVYGDKLTVIVENATDIDGNSLTGMVTGMISTGDDDISFIVYVNNGQGTNTTTTAGGVGKFTGDAYFYDSMMEFMSGPEECSAYVSPANATLYLVPWDADDLSSDIAYGDTIEFGAAVFGVNLEELNGTVYYIITELNKKGEIAIVNGSGAVNLTDILDVGTYTVISYFVDDKGNYDPESSVNYTNFKVAKATPTLNVENAQQVYADTNTITFNVTGIDDKGVKGTVIAIKPISEDVSGAIYDPETGLGELTFNGLVVGDNPIVVKFLSDDDNYANAEKTINITITQATLAIDSTITTQEIVYGKDVEADVTVTGIVQEDTVIANVSLYDNATGELLDSFNIALGLEDSISFEDLEVGDYYYTIEFTSELYAGDNFTSEVFTVNTAEILDLDSSNVDNVSYGEGIDITVYVDGMIEGDLIEVNFTVVDATTGDDVFNGTYNISNGDVITVPPLDVGKYSYSVSFYGDDKYNTGGADSIAAVGSFEVLDMSDVDVLVTADESITYGEKVTVEIDPIVSEGGLPVTGTATIYVYDDPASVDPVYVLADVELDKDGATAVLDTILPTGEYWIVVDFESDDGYYDGRGVTSTIVDLALAKLSIDPITVTYGETIPITVTALGNGGELLNGTVEFKIYGPGFEGTVTVKNGTGVTNITERFDVGTYTIIAAFGDDGANYEGFNITSLEITPATPIVRVTGSEVEYGEPSTVTVSVSDIDGMPLSGKVIVTVDWVVDGLTQVIDLDDSNEASFDLSPYVHQGTYDVTVTYIANGNYGEAVNDTETVNVTASTTATVNVEVPEDVSYGDELTIKVTAEDGAGEQIPLEAVNVTVNGETKEYPVDENGTVNLGVLPAGDNEITVALDDGTHKPTKTEATAKVAPAEAVVFVDTDNDNPSYGDVVVVTVNATNKDKPIDADACLVVDGYLIGYYDLEDGQVEISIKDLAPGKHEIEVSVANGNYSEGSYGRAIVNVDKATPVISAEGETVEWGEVATVKVNATGANGEKLNIPLVVRVIWEVSGVDELIEIENGTGEAAFQISNYVAPGTYNVTVIFLGNDEYYPVNNTEAKIILTEPKTVEMEVSITPDEYGKATNVTVTLKDVASKPLEGSTVTVTVDGKEYANATIGEDGTVTVPVEGLEAGNHTIAVDFDDGEHSPVHEEENIAIEPSTDATVEATVNVGENETTVDVIVKDSTGEGINGTVIVYVDGEPVANTTVGNDTSSVSIGQLAPGDHTVDVEFVNPNYAPTSYSTHVTESTSLTNMTVKVDKKNILYGESDITATIEFTSEGKALDGVVEVLLNGEAQNVTVTGGKATVKFSDLAADHYTVVSNFAGNATYAPSSDSANFVVERKATKFNYNDMNTTAVNPNVDGRIGEYFYFQLVDQDGKALANKSVSIGFNGKVYNRTTNETGWAKLQINLRIVFGYTFAISFLGDDNYTGAFNVALINVSAQTPKLSTSSKVYKASAKTKTLTAKLLTSSGNVDKGKKLTFTVNGKSYSATTNDKGVASVKVSISQKGTYSFTVKNAKDNTYASVSKTAKLVIK

SEQ ID NO: 7486 - protein, 597 aa, Methanobrevibacter ruminantium
MFKLQSLELSGMSDEELKGLNLEGKTFGVIGVCGVVGNLVARIIMDNGYEVIGTDISSKEDCRFYSSFDDYDIEIFFGGHPDEFFKQIDFIVPPPSMSDDAKVLELAREKGIDILHLGDIFKLFKANKPILCISGTNGKTTTTTLLKHIAYSNGISPAEHNLKGMQGNNEFIPSLQTRLHGDVAILETGTDGTPGGLKSVIDLTHPNYGILTNITIDHLVDPDDHKDGVDESLSAISLDIGDDEVSHIDRGFLEYARVKGELIEGIEENDGLLIYNSDDPTIVGLLDKLNYSGKSISFGVEIDEFDNFELEIDEFDFDSSFDSVSPIKIHTKPCWCGRDIKIYETISGSGFYECQCGIKYEKPVYIAKDIDLMNRSFNLASRDDEFEFKLTLDGLHNVYNAVGAIIAAKEFLGLSNQDIQKGLSTFKGVAGRMEIIDKIEDTTIMVDYAHNPAGVETILDAISKIYDKTCVVITVSSESGVEGDFDILDSAIGKVDYIVPASHDCRYAADKLIELTKENRQEELHLNSVYTLDELCKTFVLTDEDLKQESIKTLGASEDQVIGGLKEALNLDTDIILIIGEAAFKFESAIKDFCDSL

SEQ ID NO: 7487 - protein, 498 aa, Methanobrevibacter ruminantium
MNVIVVGAGNAGRPVARLLNYAGHTVKITDPKNIEDFHMDVQKTLRLMESEGVELDLGVFKPSLDGIDTVYLSPTVPENSPAYKIIKEADLDVFTNDDFGRLADSFIDIDIIGITGSVGKTSTTHMVTEIFRTAGYQVWICSSMTQNLVSEVIVDGIIKGIPEKSDIAVLELPHGTAGLMAELKLKVGALLNIYEEHLSEFGGSMERYTQRKMFIAKNSENFITSIHCKDTVKEARPDAIFYAMVKDLPAYDPSKKSLFFDKIANFEEIAIGEGQVCNFIGDSAKGAIEIGYKFRNKSNELRKGSFQSEFHMMSYYYENAVAATAIAMAYGLSVEIIKEGLANFKGLSVHMEYIGDYNGREVYIDASYLIEGITVALDFLGDRSLVLLLDNFDTSTYRDKKETGKLMGKYANVMVATGFNEVYQRVDLEPAQELLDAAVDSDAVKVIAGTMQEGAELAIKYSKPGDTILHLGPQLMQDPEGIMEKIVTGLEEGCKKYK

SEQ ID NO: 7488 - protein, 323 aa, Methanobrevibacter ruminantium
MKRPKKMYNPEDMFIKRSNTYLGRVMHSFLKLPGRYVNSRTNQYPDFFGKERKTDATILVDLELEMEESEVLESSYEVFVSEKETEEIPQLAECLHNEKGKMIIDIEDESSKVDKQTLAKDFEYNYIIHYESGLPVYSVITTPIPLKRCKTCYISGNTVFKPIIKSYDEMDGEAKLKEFQEKYERGEYFSDLEGYELISIPRMYGEKGNEVIEEVCILFNKIKMKNGRVKIQLARCLDCLINKYGGTLEEINRLEGLINMTKLINLEKEYEDRLRQEGEEKGRQKGRQEGRLEGKLELARQFVEELGVDKVSKISKIEKNLLL

SEQ ID NO: 7489 - protein, 117 aa, Methanobrevibacter ruminantium
MYGQKGNEVIEEVCILFNKIKMKNGRVKIQLARCLDCLINKYGGTLEEINRLEGLINMTKLINLEKEYEDRLRQEGEEKGRQEGKLELARKLVKEYGVDEVVRISGLSKEKILNEKN

SEQ ID NO: 7490 - protein, 411 aa, Methanobrevibacter ruminantium
MFLTNEEEKMANGEYGETIRKSMDILIALGDIYGAEKFVDIKSAQVSGVSYKTIGQAGLEYLEDLASTSEIIYNENGTISDKSGIATISATLNPAGTDLDNWEDFGFPADFARKQVDICNAYGALGISTTCTCTPYLIGNVPRFGDHVSWSESSAVAYVNSVIGARTNREGGPGALAAAIVGKTPLYGFHLEENRKANLLVEVESELERADFGALGYAVGQIVKDGIPYFKMQNKPYEVSNGNLKALGAALASSGAVALYHVEDVTPEFANAAIDDVENKITITKDDIVSTREKLSTADGYADLVCLGCPHASLEEVKEVAEIVKGKKIKNELWVCTSINIKEAAKRLGYLETIEKAGGKICCDTCMVVAPIEQMGYEVIGVNSAKAANYVPSMCGLRVIYNDIEDLLDFE

SEQ ID NO: 7491 - protein, 319 aa, Methanobrevibacter ruminantium
MDIGKLVGNTPMIRIDYEYEGKTGSIYTKLEFYNYSGSIKDRIALYIIEKEKERGNLKDGQAIIEVTSGNTGIAFSAIGALFGHEVHIFMPDWVSLERRKLIQMYGAEVHLVSKEDGGFKKALELVDDFADEIGAYKPLQFDNELNVEAQYETTGQEIIDDLPDVNAFVSGIGTGGTLMGIGKRLKDYNPESKVFALEPSTLSILKMGMDEGSHLIEGIGDDFIPGIVDEDVIDDIVLIHDCDAINMSKIIAQKLGLGIGISSGANFLASVIMDNDDLKIATVFPDDNKKYITTKLSEPIDENPELISNKINIIDFEVV

SEQ ID NO: 7492 - protein, 432 aa, Methanobrevibacter ruminantium
MLKKHIENEDIIRLISHNDADGLSAAGVIANAIKEEGGQFHITIVPRLKPDVIRDVSKEKYELYVFSDMGSACIKQLNRLKSDVIVADHHQPSEHEPKDNLIHVNPHLFGIDGSRHLSGAGSSYLVVRNMNKKHLAYMALIGAFGDMQCANRFTGINQLILKDGQEAGNLELHEDLKIVSKAQEPLYKSIAYTLNPALPGLTGRLDNSQELLEKMGVSYGISFLDLEDEEKDVVKDELVKVNPQIFGDVYSVPSEHPVLRDLEEYSSILDACGKNKEYGLALSIILGEREKSLDEALKLQKRYREDLTKGFEWISREGAQQLGSIQYLYSEDKVLKSIMGTIAGVGMSAKILSDEKPVIGLSRLHNDIKVSGRATRFLVARGVNLGKALADASVNFGGQGGGHDIAAGAMIPYEAKDNFLHLLDQIVEDQLQ

SEQ ID NO: 7493 - protein, 132 aa, Methanobrevibacter ruminantium
MARPDWIMYSNEEIEEFIVKFKREGKTASQIGIILRDQYGIPSVKEVTGEKITEILRRNGHADEYPEDLMNLIRRAVNIRDHLEENPKDLHGRRGLTIIESRIRRLGRYYAANGQLPEGWRYDPTKAALLVK

SEQ ID NO: 7494 - protein, 185 aa, Methanobrevibacter ruminantium
MITFITGNEHKVIEAENIFQIFGVKLEHIDLGYMEPQGTLEDVSKFGAKYACQELNRPVIVEDAGLFIRALNGFPGTYSSYVQDSLGNENILKLMDGIDDRYAEFRSVIGYCAPNSEPKVFLGRVKGQIAHEERGNLGFAFDPIFLVPEEGKTFGELTTEEKNQFSHRRNSLEKFINWYVSQDDE

SEQ ID NO: 7495 - protein, 565 aa, Methanobrevibacter ruminantium
MISLGIEGTAEKTGIGIVDSDGNVLAMAGKQLYPEVGGIHPREAAEHHAKWIPQLIPQAMEEAGLDYKDIDLISFSQGPGLGPALRIVASSARSLALSLGIPIVGVNHCIGHVEIGKLDTGAKNPVTLYVSGGNSQVIAYESGRYRIFGETLDIAIGNCLDHFGRETGLGHPGGPVVEKLAKDGSYIDLPYVVKGMDFSFSGLLSSALRAHENGERIEDICFSLQETAFAMLVEVTERALAHTEKDEVLLCGGVSANSRLRDMMKIMAEEHYAKFYMPEMKYSGDNGVMIAWLGQLMYDNFGPLDIKDTAIIQRFRTDEVDAPWVDNRKEKLNLPEELKAKGAESDIFEAKWLGMDAIVKQRVSKSYRIREIDDKIRRQRTKSEAKILSDVKKTGIRSPILYDINLDEKYIVMEKLNGPLVKDVMHKLDYDKRKELSYAIGENIRLFHDGDIIHGDLTGSNMILLSDDSNDSNDDFSKSDDDFNNGVNLDNLDFANNLAIFDFGLGKYSDLLEDKAADLLVLKKSFQSIDYDIANECFNWILESYGSDKIIDNIADIESRGRYTH

SEQ ID NO: 7496 - protein, 354 aa, Methanobrevibacter ruminantium
MIEGLKTYGSDKIVDELKDLKNPIFICTIATTETSKIPGLTGAGATPELTKYTPAGDAELILEGEVKCMKDIPQTVIGEVVTPTPSMITKGSLALCDCPVMVLDAGSEIKAQTDVFDISDGKHGMDIRTGKAVEDSEELFEKGYSLGEILSEKHGYIVVGESLPAGTTTALGVLVGLGYDAKGKVSGCMNTNPHEMKNELVDEGLKNAGIVPSKDNNPFDVVNAVGDPMLPAVAGLIMGSSVPVVLAGGTQLTAACAIVKALDDEFDFSNTCLATTSFVVKDETANILDIISQIDDITVNAVNPNFEISKVEGLKNYTKGYIKEGAGAGGAMFLALLLGNDINSIRESIEDACS

SEQ ID NO: 7497 - protein, 66 aa, Methanobrevibacter ruminantium
MANDNFQVNKQFAKFKGKNVLIGLKNWEEVEGKIITIDNFLNLVLDDGNGLKVIKGGKVAFISIQE

SEQ ID NO: 7498 - protein, 48 aa, Methanobrevibacter ruminantium
MAINQLEATLQAVTHTLAKLEKEGCSDEKLLKELREERDKLLHELNLN

SEQ ID NO: 7499 - protein, 260 aa, Methanobrevibacter ruminantium
MIHMKILLSNDDGVNASGILAAKHAVEDLGDAIIVAPSNQQSGIGHALTLFEPLRVNKVILADNDIGYGVSGTPTDAVTIALFELLDECPDLAISGINTGMNTGKAELTTSGTLGAAIETATFNIPTIAVSQHVSDDDLKFDEGEIEIDFSSSVKVLRELVKKIIKDGFPKGIDILNLNVPSHPDSYEPVICPLGDRMYWPVVEKRHDPRGREYYWINGDEYVGNPKDSDIDILNQNIPTITPLTLDMTHNMDYLREWYG

SEQ ID NO: 7500 - protein, 236 aa, Methanobrevibacter ruminantium
MLSIGQCYLEFVNKILKEGKETYKDSDHHLKEYLGNYYYIDDPLDLKFRAKYQHMTPELMLEEIKKGRYDIDACPIKGDALYEYVKSFEIRDDQGFVYTYPNRILEHFGVDQFEVMKERILTATGSNRAVAVTYDPKLDHDREDIPCLQFVQMLVRDGELTIHVIFRSNDIFGAFYSNMFFICYMGIKMKEEVNKEIMGEKLNFGGIHYHSTSGHIYNNDMRAARKLISANKAALK

SEQ ID NO: 7501 - protein, 307 aa, Methanobrevibacter ruminantium
MAFDENGKVWMDGEFVALKDAKISVLSHVIHYGSAVFEGIRCYETENGPAVFRLQDHVHRLFDSAKIYKMDIPFTEEEICDAIIETIKVNNLKSCYIRPITYRGFGELGVNPLNCPVETTIAVWEWGAYIGEEEMEQGANIGISTWRKPAPGTLPVLAKAAANYMNSQLANLEAGEHGYDEAIQLDYHGHVAEGSGENIFIVEKGKIVTPDLGSSILQGITRDSIMTIAKDLGYEVSQETISRERLYLADEVFFTGSAAEVTPIRAIDNRQIGIGSRGPVTKELQEKYFDAVNGRSEDIHNWLTYVE

SEQ ID NO: 7502 - protein, 333 aa, Methanobrevibacter ruminantium
MVYVGMDHGTTGISFAIMDDEKVLDVFKISREDSKAGRVSAIEELSKRIDLEDIDLMIITYAMGDGISTILPMEKVENRGILSIGGAGKVTGGGTSVYSEIENANLPVLMIPGLHKDCDWLDPLFRAAYSHHASPEKVSIVYNAYLETQWENMVVADISSNSVDLLIEDGKIKGAIDACCGAMGIVHGPLDLEMIRDIDEGKRTANECFSHAGAVKIANVDNKVALMKDELLEMYSKGDERAVLAIDTMIMTVAMEIAGLIAVSKNEIDGIVLTGSMGSMKEPVDFEAGLNKYFKNKYETRIISSESGAIGAAQIARDIFNGKRDIMGIKVDY

SEQ ID NO: 7503 - protein, 331 aa, Methanobrevibacter ruminantium
MKMYYDDDVDAEVVADKTIAVIGYGSQGRGQSRNMADSGLNVIVGLREGGSSWQKAIDDGMNVKTIEEAAEAADIIHILLPDETQEKVYKEQIAPYVEAGNTISFSHGYNIHFGLIQPGEDVNIVMFAPKGPGSRVRTTYLEGFGIPGLVAIEQDATGDALQLALGMAKAVGLTRAGVIETTFKEETETDLFGEQTVLCGGLTALIKAGFETLVEAGYQPEIAYFETCHEVKLIVDDIYENGMAGMWHDVSNTAEYGGLTRGNRVITDATKAEMKAILGEIQDGTFKKEFADENATDAANLKEMRAAEERETIEVVGKRLRIACGLQKEDE

SEQ ID NO: 7504 - protein, 163 aa, Methanobrevibacter ruminantium
MREKSHVISTLVEHKPGVLQKVAGLLNRRGFNIDSITVGASEVEGLARMVFVVKGDEKVLEQVIKQLHKLVEVVKIKDLDPEYVLKRELCLVKVKTTKEKSRSEIIEYADIFKAKIIDVCDDFITMEVTGNPEKIDSFLRLLKPFGIKKIARTGPTAIARGHH

SEQ ID NO: 7505 - protein, 631 aa, Methanobrevibacter ruminantium
MRGGDAIIKALMDKGVDTIFGYPGGTVIPFYDMLYDSDLRHILVRHEQCAAHAAEGYARASGKVGVCLATSGPGATNLVTGIANAYMDSSPIIAITGQVVSNLIGNDAFQEVDIIGITMPITKHSYQPKDANDIPSIINTSIEIASTGRNGPVLIDVPKEVQEMELDEYVLGTIPTPGYKPSVKGNDKQIAKAAKMLLEAEKPIILAGGGTILADASSELRQVAELVNAPVATTLMGKGVIDEKDDLSIGMLGMHGKQVANQSVNKSDCLLAVGVRFSDRTTGKLEKFMPDAQVIHIDIDPAEIGKNVPVDLPIVGDAKIVLAKLADELASSRFAEEFDDDELSGSKIIKGLMENDLAKELYKSKLVKEIESSKFKENYEFNYDSYSPWLKSVVDFKNATIPRVSYSDIPLKPQQVIKEIASSITDDTIVTTDVGIHQMWAAHFLDISKPRKFISSGGLGTMGFGLPAAIGAKVACPDDAVLAIVGDGGFLMVSQELATIKEHDIPVVIAMLNNRKLGMVYQWQNKMYDKRYSETDMGNTPDFVKLAESYGINAVKVEEVDKTQEVLSKALKDNEAILLDITVEKDEFIPMFPPGGAITDLLGEYKYESDVKNVDLEQKESEDSQTVEGGK

SEQ ID NO: 7506 - protein, 458 aa, Methanobrevibacter ruminantium
MIFSKLENNQLLKKLLNGEIKMKVLVVGTGAREHAICDALKDDVDLYAYMSKNNPGISKISTFKKGDEGEVDEVAKFAKENEIELAVIGPEAPLGKGIVNALEAVGVPCVGPAQESARIETDKSFMRNLFEKYQIKGSLTYKVFDNYEDISAFLDTYEKDVVVKPVGLTGGKGVKIVGDHLKDNQDAKAYAKEVMDNAMGGFAQVIIEEKVVGEEFTIQAFCDGENLAAMPAAQDHPHAFENDQGLITGGMGSYSDVGGLLPFLTQEDYDEAVDIMKETLKAIAKETTPYKGILYGQFMLSKDGPKLIEYNARFGDPEAMNVLPLLKTPMVDVCKAIVDGKLEDVEFEDKASVCKYIVPDGYPDTPHAGELIEIDEEAIEALGAKVFYAAVSQEDDGVHLSGSRALGIVAQGDTIAEAEKIAEEACGLVEGNVYHRRDVGTEALIQKRIDHMEAIRNE

SEQ ID NO: 7507 - protein, 298 aa, Methanobrevibacter ruminantium
MNECVIFMSKQAKSKNTIIKKAKKLERQGKYIKALKVCDSYLDNERSEETLIQLKIDILVNLYNNDTFINEINENKSKITDFIERDEEIELLKLYNTLDNYLELNSQNMADERKVGTYLAGGLLVDNLETILVLNEMAKDNKAENKEPFKANSDLLEFIYNVKKTSYQYLDLILPNSLELLANSNFNIEAIISKIRQFLEPKKSTDSKEESIKENEEDDSDQSDSKNALKSKDDTELISDYSIEDEMKGLKEMISYLNDKNEFKKALIYQRRLVKLAREENIRAEQDHDSKQKTLSDY

SEQ ID NO: 7508 - protein, 304 aa, Methanobrevibacter ruminantium
MRSLLSVCDIEEEVETILNIASDFKAGKIEEKPLKDQKLAMIFQKSSTRTRVSFEVGMYELGGTALFLSTNDIQLGRGEPIKDTAKVLSRFVDVIMIRAIEHDDVIELERESDVPIINGLTNLEHPCQALADMLTVKEHKGGFDGKFVYVGDGNNVCNSLLLICGCLGMDMAIACPDEYRPNEEITKKAKEYAKANNSTITITSDIEEAVSGADVIYTDVWVSMGDEEESEKRRADFKDYQVNQNLIDMADDDVIFMHCLPAIRGEEVSAEVIDGPHSVVYDQAENRMHAQKAVLYYFLKELYK

SEQ ID NO: 7509 - protein, 327 aa, Methanobrevibacter ruminantium
MEFNDPALEHLVNKITVALNENNKEDAAHYMDIIIDKYPEVANILMNSIEFQNIMAQNEDVEGEEASDDFAIQPGSAMELDEEKIINDMNAMLDIEPTTAQEYIQKGTVLTVTEEYEKALECFDKALELDENNLSALISKGNTLELMEKFDDASKVYDDVMNTEVEEVYDLMSKGYIFEGHQRYNDALKTYDKALQKERYNANILFLKGSCLIKLEQYQKAIDSLEEAIERYSENPYETIFELENAYHNKGVSLHAIGEDDDALEAFSLALGLNPEYYYSYYEIGIIQEDREKYDSALKNYNKFLEYDNTDSEVVEAKERVEELLKE

SEQ ID NO: 7510 - protein, 573 aa, Methanobrevibacter ruminantium
MYFKIKTEAEEALRKAVDQFDCEFDEEIKLEFPPNPELGDLASTISFQLAKLLRKAPNLIAPEVVEKIELPEIFERVEATGPYVNFFINHDIFAKQLLDSVDEDYGQLAAVDEKIILEHTSANPNGPLHIGHIRNSVIGDSLRRLLTKAGYNVDTQYYVNDMGRQLAMIVYGMEELGLKLEDQPASKIDHKVGELYFKVNQMIKEDESLNDGVDATIRKYEGGPSELDEKFEYAVNSCLEGVKETLKRMNVKHDAFVWEGQFVRTGIVDNLTQELYDIGYARQEEVLYLDLSEFDIPKELVLRRADGTSLYSTRDIAYHIYKSKNCDKIIDIFGSDHKLAARQVELALEILEEIEPNSDKIEVIFYEFITLPEGSMSTRRGVFISVDELMDEAVRRATEEIISRRPDLDKETIDKIAEEIGIGAIRYYIARLSPEKHITFKWDEALSFERGCASIQYAHARACKLLKKAQEEKGIDLADLTVEDTWSLDENEKELVKLIAKFPSLVEDSAKIRRVHPIAQYCQDLASAFNRFYKAEQVIGSDVENARLLLVEKSRITLRNALDLLGVSAPDMM

SEQ ID NO: 7511 - protein, 551 aa, Methanobrevibacter ruminantium
MNSDNIKKGVQRAPHRSLLRACGLNDNDFDKPFIGIANSYTDIVPGHIHLRELVDYVKEGIREAGAIPFEFDTMAICDGIAMNHDGMKYSLASREIVVSTVESMTMGHCFDGLVLMPSCDKVVPGMLMAAARLDIPSIFLTGGPMAPSTYKGKNADLITVFEAVGELSSGKITEDELFELESCACSGAGSCSGLFTANTMACITETLGMSLPYCATTLALSEEKKKLAIETGKRIVEMVKEDLRPSQIMTQEAFENAIAMDMALGGSSNTALHIPAIAYELEEKGVHADLDLFDQISDKVAHIALLSPAGQDTMADLHNDGGIPAVLKTISSKLDTSVMTCTGKTLEENLKDASVTGNGVIHTLDDPIHEAGGLTVLKGNLAPNGSIVKSAAVPEDLMHLKGPAKVYNSEEEAVEAIFDHQLKEGDILVIRCEGPKGGPGMREMLNPTSAIMGMGIKNVGLITDGRFSGGTRGPCIGHVSPEAMSGGPIAALKDGDIIEIDIANGNLSVELSDEEIKERIEKADLPEKKVKGWLNIYRRSVSSADEGAILR

SEQ ID NO: 7512 - protein, 107 aa, Methanobrevibacter ruminantium
MDIKGTPINVEDMIQYQKDSVVSMEIIKKELGTVTLFAFDQGQGLSEHSAPFDAMVQIVDGEAEITLAGEPHTVKKGEMIIMPANVPHALQAVNMPYKMVLTMIKSD

SEQ ID NO: 7513 - protein, 432 aa, Methanobrevibacter ruminantium
MSDFNMFCYQCSQTARGSACTNAGVCGKNATVARLQDNLIFSMKGISAYNYHCKELGVSDESVDEFLTKGLYTTLTNVNFDIGDLVQLALDSGEANFKVMKMLKEAHIENFGEPVPAEVKVGAQEGPGILVTGHDLKALEELLKQCEGTDVKVYTHSEMLPAHGYPELAKYESLAGQLGGSWIDQRKVFADYNVAILGTTNCVLPPKDAYADRLFTMDIVKIPGAQVIEDYDFKPLIDKAIELGGLEAEELSTISTGFGLSTILSLAPKIKELVLEGKIKRFFLVAGCDSPNPRMSYYREFVENVPEDCIVLTLACNKFRFNNLELGDIEGIPRLLDLGQCNDAIVAIELAVALCELFEMELNDLPLTIVLSWMEQKAAAILWTLLYLGKTDMFIGPVLPAWANDDILNVLVENFNLTPISTPKEDIKKVMG

SEQ ID NO: 7514 - protein, 264 aa, Methanobrevibacter ruminantium
MENIIESLEKFGLTRYEAKAYIGMTNIISGKAEDIAKASEIPRSKIYSTLKELDKKGFITITHTRPIEYKVVPPREVYKRKKEELIKELEDSEEKLDEIYNSQISEVQAPIWLIKTSKNIINKEVEIVKKTRKSLNMRVGFLLEGEGEELIKAFNSIPRNIPIKILASPYCYINQERIDIIELFESARLENLEIIKADIPFVKIIIRDEKELFRTIVKFTGKEKSVLPETAVGVLNQYSDICKNFDERFVNQFNRIKAKKSSMN

SEQ ID NO: 7515 - protein, 258 aa, Methanobrevibacter ruminantium
MLKAIFKGGDFQCSQGNGTIIFELADNSSKLIFGPDGSVASLISSDILENNYLNGGMDLGTFNFLKNSTIISNLKSIVNSSYYDINCLSNWIISLVNDSDINFTAIVSYLSDPKLVASVVGGLLFEAGMIALPTGLPGLALLGLGTVLTAYGSGMFDDLGTDHPGYAKPENQLNFGLSMTLNFLGLGGSEGFLRGVLYNEVQEKLVVGFVPSIKAYGKTIIKETFYDDNGVLAGVAKSYFDNILQNILFDTFLKWGVR

SEQ ID NO: 7516 - protein, 79 aa, Methanobrevibacter ruminantium
MNEIVLFGEDMKEDPHKYIKETLDFPDYYGENLDALFDCLSEVYNKTIIIKDSVLVDEDIIQTFVDANDENPDMDLILD

SEQ ID NO: 7517 - protein, 608 aa, Methanobrevibacter ruminantium
MRVLLIHSDYIKYQVKNKTPVAEEIEEAKESNAFEEALVVFTAVEKEDEKNPNAVVKNLVAEVKKTNEEVNAERIVLYPYAHLSSSLSGPKVGVQVLKDAEAALKEEGFEVFRVPFGWYKAFELSCKGHPLSELSRTIGAEEEAEEEEEEKKPSKWLIFDDGETIEPKEYNYQSKDLEKLVAYELGEGASDEGEPPHVKIMREKELCDYEIASDIGNLKWYPKGRLVRDLLADYVYNFVVDLGAMPIETPIFYDLANDAIREHAAKFGERQYKTATKKDLMLRFACCFGAFRVLGDSFLTWKNLPAKVYELSTYSFRFEKRGEVVGLKRLRAFTMPDMHSFCADMPQALEEFDAQVDMCVQTGVDLDVNYEAIFRATEDFYEENKEWMEATAKRIGKPLLLEILPERKHYWSCKIDFAAIDYLGRPIENPTVQIDVESGKRFGIEYIDEEENPQNPIILHCSPTGSVERVICSLLENTAKEDGKAPMLPTWLSPSQVRILPIGEKHLEYANQLADKIAAENIRVDLDNSDDRVGKKIRSASKEWVPYIIVIGDKEVENDVYSVTVRESGEKVDMTAEELIAEVKAKTEGMPFRRLPLPRNTAERINFK

SEQ ID NO: 7518 - protein, 412 aa, Methanobrevibacter ruminantium
MVKKDDTMFIGEALIGDGDELAHVDLLIGRKDGPVGNAFANGLSQLSVGHTPLLSVIRPNLMTKPATIIIPKVTVGDLDDASKIFGPAQTAVGRAVADAVEEGIIPKNKAEEWVINASVLISPAAEDYRKIYQYNYAATKLAIKRALDGYPDMKKVLYEKDRGTHAIMGFKAIKLYEPPYLQVALDLDNEEAMARIIKQLPNRERILLEAGTPLVKKFGVGIVGKIRELAPSAFIIADLKTLDVGRVEVKMAADETADAVAISGLGTIESIEKAIHETRKQGIYSILDMMNVDNFTEKLQQINKDLMPDIVLLHRNVDLESKLRAEGKNLDDISAWGNIKEIKEITGGLAAVAGGITPEKAEEAFEKGADIIIAGRYIIGSGDPRRAAEDFLAHMPVDPNHMRVVMEDDEQI

SEQ ID NO: 7519 - protein, 104 aa, Methanobrevibacter ruminantium
MGFCNSCGRPMGRNDYGTNEDGSPNQDYCKDCFQNGEFTEPDITINEMIIRNAERMLRRNRDLREEEATGILCNFLPNLKRWNPNPDDEIEDEDEPVRGYRGGF

SEQ ID NO: 7520 - protein, 337 aa, Methanobrevibacter ruminantium
MDFVKGIVKKYFRSYNRTLKDGTKKTYKTEQVQVTIPKSDNVFDDKEEVFILSKNQFDEIQDNEELISAMELFNAMQSEDIKNLNYSLDEARQELYSNSSKLESFTLELDDSKLELDKSNKKLLILKEDCSNLRDQLEESKLTIVNLKDQLDNKNFIIEDLNEYVNSLNNKVDSLNGEIDNLNTINAELNDNLNNLTNELNNNELNNGLGNGLNGFNNGNGLNGNGYNNGLDNNGLGNGLNGNGYDNNNLYGYNNGLNINNNHLLSSTVDEDSEVLISDVKSSVSFDYSDYIELQREYIVLLRKYEEAQENLYNEKVKVIHYRSLLEKFKAFIARLE

SEQ ID NO: 7521 - protein, 5985 aa, Methanobrevibacter ruminantium
MISFLIILLLNKGGHFINTKIINSILIILILFCFISLLGTASAEDIYTDDIASIDASNDFESIEISNEEVSTNAVENLDVSADDSDYVVNGSSSKNVLTANELSATYDLSGSSVQNISDLFNSGTIQSGDVIYLGNQSISSSWDEWTGNHLINVNVSNIIISGGSSSNPDGTSTINANGAKLFNIQASGVTLTNIKVINAHGGNGPGCINFDGSDCSIINCEFENCQYAQGGAIHGTSSASNLIITNCNFTNNVGRWGGSGGAIYLEGSGCKVTDSRFEGNTAQNYGAIYCAGDINLNNCNFTSNGPGAIYGGGNTEVIDCNFISNTGSSVTVISGGSTKVRNSNFTDNAGASIYSGGNTEIKDVIFTNNGAGSYNNKNVGSVYSGGATTDVSNSKFDNNAGIAIYANENAFVDGCNITNGGVAIYSGSDANISNSIIENNSADQAIVYIYGIGKVNNSNFTNNTVSGHTHGGALSLIGDNSEVSDSIFADNTAGASGGAIYTTGENTMIKNCSFTDNTVMQDYGHAGAVDVVGVNTKIIDCNFTNNSAPNGGAVYGGSYGLSLSNSVFEDNNASTGGALYIYHDDFAITNCNFTDNDASSQGGAIYIASECHNEQMTGCNFSGNTAPRGSAIYCDGDGKVTDCNFDVKPDLTVSGGNSSLTVTLGSDYSNVVVGDIEGVSGGSVTPLVDAQVTVEIFDSRGNLVDSVTNATDENGKIKYDYSGLSYGSYTYRASHMDGDTLITKEGTLTRQASLDVRTGYPALTSTLGLQTSIDGTAVENDPFVNEDITVEIFDSRGNLVDSVTNATDENGQVYYDYSNLQRGTYTYRVTSSDGQTEEGPLSMGEVVGDNFSAIQAAIDNAPSGGVIFLQGKTYLNDIQGQMVIDKPITIIGTDGTVLDAQGISRVFEITSDADNVNLANMTLTNGNDVYGGAIYLQSGCDDGTLTDVVFDSNTAELAGGAIYNAGGNRWTIDNTTFTENEAHGETNYIYRGGGAIWSCDAEMILSNTTFVNNQAPYGGALRGAFDIYDSLFDNNTATDGNGGAIDVTTEEFLYDTLILEFRNSTFVNNDAKGSRGDDRAQGGAIHIYHLQEVNMYDCFCENNTADRGGAVDFYELGKTWVDNCTFVNNNASSEGGGLAIFCNSSTFKDSNVSNNIAGTDGGAIWVIGHNSLFNNVTSENNTASRGGSSYIEGENTTIYNSTFNNNNALYNESLGSQSGIGGALDILGDNCKVIGVTSVNNTAELGGSTFIRGDNTLVQNTNLSNNTAVFNESRNETSGIGGALDVVGNNCQIINVTSDNNNAYRGGSTFIRGNDTVIRNSTFDNNNATLRGGGLNIAGEGCTIFNVDVSNNAAGENGGGIYVIADGTEFRNITADNNTAERGGGAFVEGNDIIIDNGTFNGNKAIFNESKPDESGIGGALDIKGHGCNVTNVDSFNNTAYRGGSTFIRGDNTYLENCTLDGNNATLRGGGLNIAGENCTIHNVDISNNTAGLMGGGIYVIADGTVFRNITADNNSAERGGAVFVEGNDIIIDNATFNDNKAIFNESRPDDSGLGGALDIKGDGCNVTNVNSFNNTAYRGGSTFIRGDNTHVENCTLEGNNATLRGGGLNIAGENCTVYNVDVSNNTAGLMGGAIYVVANGTEFRNITANNNSAERGGGAFIEGNNVTIDNATFNNNRAIFNETRPDESGLGGALDIKGDGCNVTNVNSTNNTAYRGGSTFIRGDDTYVANCTLDGNNATLRGGGLNIAGDRCIIDDVDVSNNNAGLMGGGIYVVSNGTEFRNITADNNTAERGGSAFINGTGITIRDGELNNNRAIYNESRPDESGLGGGFDIVGDNILVDSVHSNNNSAYRGGSTFIRGSNVTVQNCNLDNNTATVRGGGLNIGGGDGCKVINVSVSNNDAGEDGGAVYVIGDFSLFDNVNSTNNTAQRGGSSFIAGNNVTVINCNLDNNTASNRGGGLDVNGSGCVFENVTLSNCHADKEGGAVYVRGDNVTFNNVTSENNTAERGGSSFVAGDNCKVINCDLNNNNATWRGGGLDVTGTNCLFENVTLSNCHSDEDGGAVYISGDDNRFVNVTSVNNTAVNYGGSTYIGGTSNSVENCTISNNIAYNGGGIFIEGEDSKFTNNNITFNKAIATDEDHDFNIMGGGVFILGGNSNFTNNNISSNHAKDNGGGVQIFFGPDTFMDKIYAFNNTAENGGFANLLYCDNLNVTNSTFYSNHATGDISLDRGEGGAFHMSYATNIDVQGNFSYNTATNGSAIYSDGSDIRVHDSSFFDNQAHSWFLLITPSDETYLKGQDVIINISHIGGDNIANAIHNRDAESSITVRNVTYPFYNNGVLINKTTPIDEDIPIEIIGYENSDNGNLIYIDDLEDNQVIYYNITNRDTNESILVGFNKTDISGTVSLRLTNLPAGNYVVSAYYPETTYYTEIRNVSSFRVIDVDMVANKTVDNQTSNVGDIRDWNVTIWNDGASEAQNVTIIDFLPDGLNLTDNLTIHFYNGTGGLWNNAVLNLTSNNLTFSVYNKADGTWINGVASYDESSNTWTYYVLSLADNRTFAYSVFNQSDYTDAFGEARYYEDINSWTYRNISYDVDNADWYYYTFEYDDHTYVYGVFNGSYFVDAFGEARYYEDINSWTYRNISYDATTGNWYYYTFDYGGNTFVYGVFDESFFVDAFGTAIYDDGSWNYENISYNATDGKWYYYSLNYGDDSNNVTYYIFNPENFVDVFGSNYHYNAENNTYVYVNAYYDAETDSLIRNDTIYNVSSGIWTINNRLVVPELVSINPNVSYISPEKIYLVNKISLSIANHTNSTDISLDVGRFDGNGSVLMNLVTNVTKRGNFTNIVNVTTDSPEKNYTNNVANNSTIVYNDLVINKTVSDNLTNVSGIVDWNVTVLNNGTFEAVNVTMNDYLPDGLDLTNLTVKVYNGTGSLWTNATLDLSTMTLSFSVYNETSGEWISGIAAYDQAAKTWTYYVLALDDDVLTYTAFDETFFSNLFGDAFYNESSNVWTFVNRTYDEVTGDLISEVNTTYDNNTGIWTIGDKTFVEYKVNLTLVNGTNSTNLTLGINSLDENSTMVMNLVTNVTKYGIFTNVANVTTVTPETNYTNNVANNTTETLTNITVTKVWDDANNQDGIRPTSVNITLIGSDGSERSVLVTGTGGVWNYTFTDLPMFNSSGDSIVYTVNESVVPNGYDVSYNQSNWTVYNTHVPEVTNITVTKVWEDANNQDGIRPTSVNITLIGSDGSERSVLVTGTGGVWNYTFTDLPMFNSSGDSIVYTVNESVVPNGYDVSYNQSNWTVYNTHVPEVTNITVTKVWEDANNQDGIRPSSVNITLIGSDGTERSVLVTENNGVWNYTFTDLPVYNGTTDPIVYTVNESVVPDGYEVSYNQSNWTVYNTHIPELVNITVTKVWEDANNQDGIRPTSVNITLIGSDGTERSVLVTENNGVWNYTFTDLPVYNGTTDPIVYTVNESVVPDGYEVSYNQSNWTVYNTHIPELVNITVTKVWEDANNQDGIRPTSVNITLIGSDGSERSVLVTETDGVWNYTFTDLPVYNGTTDPIVYTVIESVVPDGYEVSYNQSNWTVYNAHVPEVTNITVTKVWEDANNQDGIRPSSVNITLIGSDGTERSVLVTETDGVWNYTFTDLPVYNGTTDPIVYTVIESVVPVGYEVSYNQSNWTVYNTHVPEIVNITVTKIWEDANNQDGIRPGSVNITLIGSDGTERSVLVTENNGVWNYTFTDLPVYNGTTDPIVYTVNESVVPVGYEVSYNQSNRTVYNTHVPEIVNITVTKIWEDANNQDGIRPGSVNITLIGTDGTERSVLVTENNGVWNYTFTDLPVYNGTTDPIVYTVNESVVPVGYEVSYNQTNWTVYNTHVPEIVNITVTKIWEDANNQDGIRPISVNITLIGSDGTERSVLVTGTDGWNYTFKDLPKFNGTTVPIVYTVNESVVPVGYEVSYNQTNWTVYNTHVPELVNITVTKVWEDANNQDGIRPISVNITLIGSDGTERSVLVTGTDGWNYTFKDLPKFNGTTVPIVYIVNESVVPVGYDVSYNQSNWTVYNTHVPNVTEINVTKVWNDSNDKYGIRPSNVTIELFADGKKVNETNLTARGAWTYTFSGLPQYNNGKLINYTIGEVRVDGYSVLITNNTVGNWTVTNTPIAVPNMTVQKIANDKVVYIGNVTSFTILVRNTGDCNLSGVYVVDSDYSAGLSYLRYENGSRDWTYDGAKWTLVGNLTTDNPTANFTVYFTVVDNGTLVNNVSAGSNLTNETNGTNNTTAYRPNMTIQKVSNDEVVYVGNITSFTIVVTNTGDCNLSDIVVTDSDFSAGLSYLTYANGTRNWNYDAVGHTWSLVGDLTNGSSAEFTVFFTVIDNGTLVNNASVRSNLTNETNATNNTTAYRPNMTIQKISNDEVVYVGNITSFTIVVTNTGDCNLSDIVVTDSDFSAGLSYLTYANGTRNWNYDAVGHTWSLVGDLTNGSSAEFTVFFTVIDNGTLVNNASVRSNLTNETNATNNTTAYRPNMTIQKISNDEVVYVGNITSFTIVVTNTGDCNLSDIVVTDSDFSAGLSYLTYANGTRNWNYDAVGHTWSLVGDLTNGSSAEFTVFFTVIDNGTLVNNASVRSNLTNETNATNNTTAYRPNMTIQKISNDEVVYVGNITSFTIVVTNTGDCNLSDIVVTDSDFSAGLSYLTYANGTRNWNYDAVGHTWSLVGDLTNGSSAEFTVFFTVIDNGTLVNNASVRSNLTNETNATNNTTAYRPNMTIQKISNDEVVYVGNITSFTIVVTNTGDCNLSEIVVTDNDYSLGLKYSRYENSSRLWNYNGGKFTLVGDLAPGNSANLTVFFIVVDNGTLVNNASVKSNLTNETNATNNTTAYRPNMTVQKVSNDQLVYVGNETSFTIIVTNTGDCNLTGVYIKDDDFSKGLQYNNKFVPVKGTWTYAGGRWNLEGQLTVGDNASITVYFTVIDNGTLVNNATAGSNLTNETNATNNTTAYRPNMTVQKISNDGVVYLGNTTSFTIVVTNTGDCSLSEIVVTDNDYSAGLQYSRYANTSSKWNYDGDKFTLVGDLAPGASANLTVFFIVIDNGTLVNNASVKSNLTNETNATNNTTAYRPNMTVEKLIYEDTVYVGDTAIFTIFVKNTGDCSLSDVVICEYWFSEGLEYNGVWVPNGDRKWDYDDETRTWTLIGDLAPEGFASFVVYFNVTKNGTLYNNISAKSNLTNETNATNSTRAYLPNMTVMKVANDEIVYLGNTTSFTIVVSNTGDCNLSEVVVTDTDYSTGLKYKNYINGSANWNYNNGEWSLVGDLTPGSSANFTVFFTVVENGTLVNNASASSNLTNKTNTTNNTTAYSPKMTVLKISNDESVYVGNITSFTILVSNVGDCDLSGIYVIDDDYSNGLLYNRYENSSRKWNYDGSRWTLVGSLEPGDSANFTVFFDVVENGTLVNNVSAGSNLTNETNNTNNTTAKPVCDLIIYKAVNATEILVYDIVEWKITVVNLGPDTALDVIVKDLLDNGLELISVSGGNYNNITGEWNIGDLEPNTPVSLSLVTRVLVNGTIVNTATVNTTSHESNYTNNNASNFTEADYLCDLVISKAVNCTNCNVSDLVQWNITVTNLGPHDASNVIVKEILPKGLELIDYNVSVGNFNEVISEWSIGTLEKDTAVSLVLVTKVLIDGTLINIATVNTTTLDNNYTNNVANNTTVASPICDLVISKIVNATKVNIDDILTWTVRVTNNGPSEALNVCVSDILPEGLMFVGYKASTGRYDDESGTWTVGKLSSGSSATINIYTKVIELGNITNPVSVNTTTVESNYSNNKANNTTEVYPIVDLVIEKSSDKIKYNVNDTMHWIIKVMNEGPCDAIEVYVYDALPASTKFIAYNSSKGTFDAAKGIWSIGDLANGEEVTLDICCKALISGNFTNNATVNCSITDKNTSNNFDNATIEIADNKSDNPDPIPDKPKHGVDISLRTGNPLLIFLMAIFAIFGGIGLRCRKE

SEQ ID NO: 7522 - protein, 198 aa, Methanobrevibacter ruminantium
MKILGICGSPRDGASSFLLKRALNELEKEENFETKFISVKDKNISPCTHCNFCLESKGECSIEDDMNEIYDSLKQADGIIFASPVHFGSISAQLKAVIDRCQALIMEDLDIFKNKVGISIVVGGDRCGGQELAIQQINTFYLLNKIIPLSGGSFGANLGACLWSQDEGTDGVKNDEYGLKTLDMTINHFKEFLLEFKQ

SEQ ID NO: 7523 - protein, 230 aa, Methanobrevibacter ruminantium
MTDVKAGVEYKINIDGNSFLLDEKKFNLLLYINESGSITEAAKRTKISYRTALHYIEKIETTLNIAIVSTKKGGTGGGGGTKLTEEGLQIVKECKKINAIMELHRDVNELEAEILEVDASKGIMKIKMEDLTMTMPLNKKYVVGDKILALISYDNIFIMLEPQASSIRNIFKGIVTEMRLQDEMVRVKIDIGGVDIFSDITLSAGKDLDLNLGKEVYIGFKALSIATLKL

SEQ ID NO: 7524 - protein, 34 aa, Methanobrevibacter ruminantium
MARVSNLSYCHVCTLCAMKCGPDAIKIIRNAPDE

SEQ ID NO: 7525 - protein, 200 aa, Methanobrevibacter ruminantium
MNIEKRDIMERTAKVSRKTSETDIEIEMNIDGKGKYDIDTGVKFFDHMLESFSRHSFIDLNIKAIGDIEIDDHHTVEDVGILLGEAFAKAIGDKKGIRRMGHAIVPMDDSVATVAIDISGRSYCNMSLDFRNDKIGDLSSDIIVHFFESFASSAKINIYGTCEGFNDHHKAEAVFKAFAKSIYDACKIEHDEILSTKGVL

SEQ ID NO: 7526 - protein, 406 aa, Methanobrevibacter ruminantium
MMNYNYDIDMENPFEPGKSVSPDRFKGREKNIKKILRDMGKVQKGNVQHFFLTGNKGMGKTSLAEFVKEYVEINYGMIGIYVSNKGNNSLNSLITAIIQAFLNKIPRNVLFEKIKTLFSSIESVEIIGNRVSFKPSKSLIVDIEKDFPYYLNQIIKDLPTNNGVFLIIDDINGLSESKKFVDWYKRFADTIEVNRGDFNLPLYVLFAAYPDKFDSLVYEEPSFGRIFHYDEIDRLSDLEVKEFFKDTFSSVNKQINDNSLELLSYFSGGIPLIMQEIGYSIYWLSEKTTIDEEDVLNGIMEAIGELESKQIRNIVNQISSDDFEDLLLKIASQKQQSYIETDFKEKLNWDEYNIWDEFLDCMIKLGVIKTSNRKSNLKFSFSNQFYFTYFWLKSLNLHEEFAKIES

SEQ ID NO: 7527 - protein, 166 aa, Methanobrevibacter ruminantium
MASIDYFECEDCGFRWKDQGPLLFFLNENNKIEEYILLISNMNLDSNSNISGDIIETYCTNCDKKIKIYIISTIKSPYDEDSAIESIRKLADENQIDNKALKPFIRSSDLKDNFYIVDLYRNFYSNKDYHCPNCDSIISKYILSKNKCPKCGGEISSVDGLCLDKF

SEQ ID NO: 7528 - protein, 278 aa, Methanobrevibacter ruminantium
MVVKIGIVKSGNIGTSPVLDLLLDERADRPNIDVRVFGSGAKMNPEQVEDVVPKLDQFDPDFCIFISPNPGAPGPARARELLSEKDLPAIIIGDAPGKGKKDEMDEQGLGYIIVMSDPMIGAKREWLDPTEMAIFNADILKVLAETGALRLVQKTLDAVIAAADAGEEIELPKLIVTAEKAVEAAGFANPYAKAKAIAAYEMAGAVAGLDMKGCFMTKGFENFIPLVAAAHEIASAAAKLAQEAREIEKSNDTVLRTPHMKEGNLGCKVDLISKPVDK

SEQ ID NO: 7529 - protein, 104 aa, Methanobrevibacter ruminantium
MKKVKITVMKKARYDDLIEKYENPLEHECEVELGDVFIANGWEKPEDFCSSAWDSISPFVLALSSGGEDLYDGWMKDKKSAMISCNDGFRPVSFYLEAMDEDAD

SEQ ID NO: 7530 - protein, 374 aa, Methanobrevibacter ruminantium
MNSKNIAIAGEITPSKTIIPLIQRLNELDKEDKLNFKINKIYGLYHGESSKLLLEPYCDELYDIGQGRRGQKKNSTAKLAYLISRDIIKAFNALKGNNIDLLITAGNAGDVRKSIVAANLLKIPILHIEQDIYNPIEVISHANLVTVPKEDYKDYLERKYNLKNVASIDGYPMAKYVDNHIKDNNLIDKEEIYGEYGVKEFVLVVLGGDLKDDEIEPLIRSVEQLNLKTLIAPYRFDRNLVESLVLSPNIKVLPQYVDLLSFMNAASHLIYAAGMGLTIEAGVFNIPSLKIEGFHKTHGSVDLARELNIPIVKIDEIPDAFEKLSAHQDNNLVKNSEIAIDKLVDLINGFDENGLQKSGFKSTKQIWNSRKVFR

SEQ ID NO: 7531 - protein, 5651 aa, Methanobrevibacter ruminantium
MRNKKIFIFTLMIVMLLSLAAVSANDLDNLEVDDGNVVSTDTVINDVPMESTSSDKIALNVDSTQSNTTEILNENEIITNNSTLSIDLNESITNEISSDHEDSYQADSNQEDSYFTSDGNIYVKVKTSMLKADGDQIYYIHPAGSPTATGTRDDPLDSMNSALNLFTSDGTHTIVVMDGIYKDTYYDYNNTDVDTNLSNLIIKSDEGASPHFNLSTSDYRRSLYWAFTGENITIDGLKFTDSQYGSFNEDGVYKYHTVLRFINSTNVLVENCVFDNDGYLINATDSSDVVIKNCNVSNSNRSNVFNVLNSSFTVQDSNLSKIRDSYITNSSFKLINNTICNNVNSNLFTVKNSSLDIINNTFKDSNYSSYYVFRIYNNNETYANFTGNNFTNLTGTDYLLQVNYYVNDNTTVSFVNNSLKDVSLGLNIRYSNLTMDGNSFDNLSLSSRPSYSGISTSYSNVSFTNNNFTNSDSYIYLGYGVNATIENNNFTDNIPSYYGLLRAEGNSHDIKENNFTNNKGNCSIIQHYSGNATIHGNHFYNNSLNGCGHVINVTSTSGSEIYKNDFVNNSADNGTVYLYGSSNVHDNNFTNNSVTGLGGAIYSYSFYNINTTIKENVFDGNNASFGGAIYYENYPSYNNKREIVNNTFINNSADFGGAIYSNKSINNIIDDNDFINNSAQIGGAIFVDYLYINDFRYNNTNNTISNNLFAENNAQSGGAVVLYSQNSTVEGNRFISNNASRYGGGALITSGNNSIIVNNTFANNTAQLYGGAIGTNDSKIIDNKFENNSAYQAGAILTINSTIHNNDFVGNEATRGPAIVYIDDFNYTALTYYTYNCSCENCSNCSGCSDCECCVTTIVDPETGDEIKIINCSNCDGCNCTCENSTVTEHNITLLYNNTGIDIDEDVYAYHENQLLRVAKENNGMYYLYDNVNVTSAENYTYWAYCIEQNNSYPWLGNGTLGVHVDDLYFVRNSLDDSYVGDYLKILISYFYHNLDEDKINVKEYIYIFTDTDYRSNNDRIIQKIIKLANNESTVLENGNNWINGVYNCLEFSTFINPTTRQNLILINGCEPLDKPDFNITKKANATHVKTGDYINYTILVTNNGTCNLHGLKVTERMNSMLIYMGFDDVSDNWTQTGDMEWMLNRTLKVNESAELHIYFMTNKVTSYTNITNVIEARSDESDTKIAEEHIETIYPKLVYRKVSVDPVAYPESTIRFILLVKNIGTANAYNVAIEDSGFSSSQLLYQGTWSNYKGTWYNSGSSATSTGRFTLNGYLAPNQEAGVYVSFKLKEGVKGTTVSNSFNVYLNNTWDGSASNFTRVVSSAMKVEKLWVDPLPIATIGDEVTFAINVSNVGEANLTGVYVEDFFPSGLEYIRFYNTDAHNWTHYETLDGTHRFILQNTLPNSQTSRTLSSSIIYVVFKANEIGDLTNTAIVKSDYTENVTDNETIIISPYGMKVEKFSNNPISQSDNQVSYVIRVTNTGIYNLTDVYVNESQNEYMVYDHFEDSSNKWIYNDSGDSPRWVYNGSLENNTYSDFIVYYNITKIPENGLIKNTVRVYSNETVERNASNETKVYKLSLWKVSNNPVSRLGDQISFTIVVKHEYNGNSYDKDLYLDGVFVKELIPDGLTYDHYVDESGKWSYDYNTDNWVYSGTLVPNTETNFTLFFNVTKMENLTNVVILGTNQSNNVTVNNSSDSRYYSMLVDKISLNETVFKGNITEFLIKVTNNGDLNLTNVTIREVIPDGLVYVGYLNKTGKWIYEGGNGASSDDQPMWTYQGILAPGESAEFIILFNATETGTFLNIVYGTSNETEEFVAENTTKVLNPLLYVDKVTLNQTVYRGDLTAFEIFIVNIGDCDLHDLYIDEIFPDGLVYYGLVDDTGSLSYDEKTQRISFDGTLKVRETLVFTVIFNTTKVGNFTNKVEVGSNETKKEYANNTTQVLEKDLNVTKVANNKTVVKGDKTEFTIDITNVGECNLTNVYVYEESFEGLSYYAYIDETGKWFKNGNKWIYDGVLKPGESVKFTVVFNTNETGNFTNIIVAGADGIPNKTANNTTEVLICDISIEKLTLNKTVISGEDTQFAIRVKNIGLGNLTDVTVTDSFPEGLTYKTFIDNSGKWSKNGNKWIYDGVLKPGESAEFIVVFATNQTGNFTNFVSVSTNETKSKNASNKTEVVLADVEIQKITLNKTVISGEETLFEIVVTNKGIIDLSDITVTDSFPEGLTYKTYIDESGKWSNSGNIWTYDGVLAPGESAGFIVVFDTNQTGNFTNFVSVKTNETKSKNASNKTEVLVADIEIQKITLNRTVISGQETMFEIVVTNKGLVDLSNVIVADSFPEGLTYKTYIDESGKWAVNNNKWLYNGVLAPGESAGFIVVFDTNQTGNFTNFVSVSSNETKTKNASNITEVLLADIAIQKITLNRTVVSGQETMFEIVVTNTGIIDLTNVVVTDTFPEGLTYKTFIDESGKWSNSGNTWAYDGVLAPGESSGFIVIFDTKDPGNFTNIVSVISNQTGNKSARNITEVIVADVGIQKITLNRTVYSGEETQFEIVVTNTGIIDLTNVVVTDTFPEGLTYKTFIDESGKWSNSGNKWVYDGILTPGKSAGFIVVFDTKDIGNFTNVVSVNTTEVGPKYSYNITEVIIKENKTNHTNETPPGPNPPGPSPPGPNPPGPNPPKPHVPTHPHKPIVPTNPNQPKLVKSNKNPLSDVKAGNPIALLLIVLVVLGSVPFASCDSGGTRRRRKTKERKAAKHKEIDKKKGIIILSGCLLLMVSVSAISAADTGDLGYDDAGSDVAVQSVSHEPAQYSYSTSENMAYDSYDYGDYNDYGGYGDYGDYGDYDGYDTYNDYYILDNNETVYEDGMENSADGNSADAANGQANQYAEDGSDMELYSIDDESYDSNDNYDNYKEYSYDDDSSREDASSIVRYNDCTVNGDNKVKSIYTSSSLAEGEGVVVYVSLDGRTGAEGTYDDPLLTIGAALTKLSTVSSTETKTIILKGGNYSGNNYRYLSTRLNNLIIKAEDGAEVNVDLRGMNQNSLYWTFYGDNVTVSGINFMNANMTSYNLNNYHAVLKFINSSNSRVEDCSFSNLKSYGILAGNSTDVVISNCNFTNGSSRMFSITNSSVTVEDSIMKNFSTSYIRNSTFTMVNSTVTDFNDDDIFNFANTDLDIRDNTFKNLTFPNKTNFQRFGVFYAWDDNAGISYNFINNTFANFTGTDAYMIYRSASSSVKPMCKVNFTDNNVSNVSVGVNIYYGNITVENNSFDHMSPANTLRFSYSNIDIRDNNFTDSNSTHVYSDRCNGTIEYNNFINNSALPVSAEWGNLNISFNNFTDNKGNFSAGAIQSTGVVNIFNNTFCNNSARVGAVNVASISSNKTIYNNTFVNNTGVSGTLYVNGNATVHDNRFIDNNVSENGGAIYAAYDNSYNNYYNISANITDNIFDGNIANKGGAIYYEQYNSAYGLDNLANNTFVNNKAEYGGAIYSNKTVNVTISENEFVNNSATIGGAIFLDNYTSAFNTGTNITLNNFTNNSAQSAGAVVVYGNNTNVIGNNFVGNNATRYGGGALVTDGANGLIYNNTFENNTAFLYAGAIGTNNSKIINNTFTNNNAYQAGAILTINSTIHNNTFSGNDATRAPSVGYIDNYNYTVSSYYVYYCSSEDCSGCTACESCTSTIIDPITGAEIKVINCSNGDVPECICEDSVATLYNISLLYNNEGLNLDEDVYVYDESTILRVALNNNDMYFLYENASIPNASEYHYWAYCIEQNNSKPWQWNGTTGVLVDDLYFVRNSLDGSYVGDYIKVLVSYFYFNLDEDVYNLKDYVYVFTDTDYRANTDRVIRRVINLTEREDTSLVNGNNWINGVYNCLSFHSFIMPTTRQNLILINSCMAMQTPDFNPQKIANKENVGTGDIVNYTVTVYNNGTVSLHNVTVTERPNSMLTYLSFTDFRNQGWVQTGEMTWVLNRPLKVHETGTFNINFRVNNVTYLTNITNYIDVGCDEVSNKSAFTRTETKWPRIQVQKITLDQNVTPGSTVRFLLLVKNIGTLEASNITLVDNFNRNELEYEYRWDSYKGNWSGGHGWGGSSSSWHVDTLYLNQVLYPGQEAGVIIYFKVPNNVTVGSAYNSVNAYRNGTSEGYSSNYTIIQRPYFSIWKTLVSSKTSTIGEEVVFQINVQNTGYVNLTGVYVEDILPIGLKYLRFYNTDNHNWTHFVDEDGKHRFLLQNTLPTYYSDSQNYVARLYIVCNATEYGNWYNLATGYTEQTNKSTSQANVTIIPFGVSIEKVSNNPISQVGDQVSFTIRVRNTGIYNLTDVYVNETRNSYMVFDHFVDNSGKWILNESYATSGVPSWNYNGTFEVGAVSEFDVFYNVTNINYYGNITNTAYVSSNQTTNRSVSNQTAAYNIKVRKISNNATARVGDQVSFTIQISRDGYSWESPFSLYGIHVKDLVPDGLVFDHADNSYYWIYNESDETWYYRSGLTAGRTISLTLYFNVTKAANITNVAIVGVNNSTVKTANNTTNSIYHNLQVEKVTLNETVYPGNITEFLVRVNNTGDNNLTNVFVKENIPNGLVYYDYINKTGKWNYTEDDDGPIWLYDGILAPGAFGEFIIRFNTTVPGIFVNNVVAGSNETSNKSTENSTKVLGPIISVGKITLNKTVYIGELTEFRIKVSNDGDCNLSGVYVVEYIPDGLKFVEFKDESGLWTYNESSRTFYYNGILERDDSLEFVVVFNATRAGNFTNVVHAGSNVTNESVANNTTEALDVRMDIQKVTLNETVFTGQETGFVIVVSNTGLKDLTDVRLKEIYPDGLVYSRFIDDSGKWFNRGDYWIYNGVLAVGESTNFTVIFNTTKSGTFNNTIIVSSNETGPKNTSNTTKVVVANVTVAKITLNETVMSGEQTSFDIVVTNDGIYNLTGVVVTDAFPEGLAYSGFVDASGKWIFDDSKGNAWIYNGTLAPGESASFTVVFDTDEVGEFTNIVKVSTNQTQDKNASNITKVIKLIPNVAIQKVTLNRTVYSGEQTSFEIIVRNNGEMNLTAVTVTDAFPEGLAYSGFVDASGKWIFDDAKGNAWIYDGILAPGESASFTVVFDTNQTGNFTNIVTVSSNQTKEKNASNITEVIIKSVPGIEIIKITINRTVYSGEQTSFDIVVSNDGNVNLSNVTVIDSFPEGLTYSNFIDDTGKWFNIGNKWIYNGILLPGESAGFRIVFDTNKSGNFTNHVKVTSNETGEKNSSNVTEVIFADVAIQKITLNRTVYSGEQTCFDIVVTNVGEIDLTNVVVADSFPEGLDYSSFVDESGKWIFDDAKGNAWIYDGILAPGESAGFTVVFDTNITGNFTNIATVSSNQTSERNASNITEVIKLIPDIAIQKITLNRTVYSGEQTCFDIVVTNVGETNLTNVVVADSFPEGLDYSSFVDESGKWIFDETKGNAWIYDGILAPGESAGFTVVFDTNLTGNFTNLATVSCNETEDKNASNITEVIKLVPDIAIIKVTLNRTVYSGQQTSFDIIVSNVGETNLTNVVVTDTFPEGLTYNSFIDETGKWIFDEEKGNAWAYNGTLALGEYASFTVVFDTNLTGNFTNYVSVTSNETGEKNSSNVTEVIKVPKNDTPPVPVPPEPVVPPEPVTPPEPVIPNKKVPRHELPRTGNPLMVLLIALAAVGLSSVRRKRE

SEQ ID NO: 7532 - protein, 502 aa, Methanobrevibacter ruminantium
MGLFRVKRIPDEKQIKLGIRTLDFNIPEDHISRFVGDFIDEYYPLLGIKENKKKKGRDSFPVKEMLKLLIYAKIEHIDSMRFLADMVKYHDVYKFVGNGICPSERSLQRYREKYGKYYNELLKATLKKASDVDYTDFNEVSIDGTIKKAYNSKNKVITEKETEILTRYFEGGRVSQEELDKLHKPAREILENKKISNQEKLYLLDDIKTQFTLSGQKSVPVTDIEARWMKSKKGNSQISYNIQSAVDYDTKMICAINVVQAPTDHYQLPKIVDKAINNTNVIPRFVLADTIYLNEESLSYLADNQINGVIPDRKQSKEKIGRLNKNPYHKDHFKYFPEIDAFECPEGQIMYFFNKYTEKNDDLDKPDKIKRLYSNYGACKACNCRENCLSSTQTHRTITEYGGSLKKAMWEKMETEEYMEEYAKRSSVEGPFGILKEQFHIESEVVIGKTKTEERILLDAVAYNLIRLFNLEQEIKNDKEDIVDFCEKISVQEKLEVRATIF

SEQ ID NO: 7533 - protein, 229 aa, Methanobrevibacter ruminantium
MLEKEVKQYKRGNSFTYRIDLSKKDNFEGGEKIMIFRMSEYEAYLNEIEDLKSQIEENNKTISELRESRSEANSNINNVVDNHNKEIADKNKEIMDLIEENKSAIQKCYDIIEEKDKLLTQANEEIRIEREKTDATRKQAQEDILNERKRHDELTLEKDKQLKLVNEQLQDSLKDIAYKDKVITADRLLIERYKNRGFVDRLLNRLPDDSDLKIDDVKETYVLEAEKKE

SEQ ID NO: 7534 - protein, 45 aa, Methanobrevibacter ruminantium
MILSLHLFCYGYFFIDFDDIVLSLHSICNLFFIDFDDIVIASIGY

SEQ ID NO: 7535 - protein, 480 aa, Methanobrevibacter ruminantium
MKVVLAGTGSAVGKTTISTGIMKALSDENVQPFKVGPDFIDPSYHTIATGNVSRNLDSFFMTDFQIINSFERALKKSNSNMGIIEGVRGLYEGISPIGDVGNTASIAKAIDAPVVLLMDARSLVKSAAAVVLGFKALDPDVRIEGVILNKVKGQRHYKKAKESVEKLADVPVIGGIPRDDKITVEERHLGLVPALEKERITRNINLWGEIAEEYIDLDALKDIMKTSSKSTARDNKNIAMEKHEDDFNREHTEAIDLEVTNDSKPGQLWKTGNRNKVKIGVAQDEIFTFYYKETLESLEENSAEIVPFSPLKDEHLPDVDALYIGGGYPEVFKKELSDNKTMLNDINKFHKENRPIYGECGGLIYLSKSIDGLDMVGAVPYSSEMTNKVQGLNYVVARANQDNLISNEGDVFRAHEFHYTKLNIDKTDSLVFDVLRGRGVLNNMDGVCVNNTLANYIHIHACSHPNFGYNFTINISELDI

SEQ ID NO: 7536 - protein, 371 aa, Methanobrevibacter ruminantium
MSTLEKMQVLADSAQYDLCDYVSHSKSSQVNLPGIYHATGHNGCKIPLFKTLMSNKCKNDCKYCINQSKRDFTRLELSPEELAKAFLHYYNNGYVNGLFLSSGISNEIDETMNKTIETARILRRDYGYQDYIHLKIIPGSSKDSIKRAMSLANRVSLNIEAATKDGLSEITSTKDYNKDILKRIDWMHQIAKKNPDYAKSGHTTQLIVGANDESDYEILKRMDSLYRKADLRRSYFSAFSPVEGTDFEKREACSSDRTAQLYHADALLNDYKFKVKELVFDEDDKLFLNEDPKILAAREMDIFPVEINTAPYRELIRVPGIGPKSARRIMSIRKKMPFKKLEDLQKLGVVIKRAEPYIQLEGAYQNSLDNY

SEQ ID NO: 7537 - protein, 71 aa, Methanobrevibacter ruminantium
MSLEEIPFEEQLRGVILEGEIERAELKGVEKGRNIIIIKLLETMNPQEISESLDLPLDTILSIQESHTKNV

SEQ ID NO: 7538 - protein, 295 aa, Methanobrevibacter ruminantium
MADAKDSKDDKVYHLEDLLFVKCLVQFEEFPQYITGFKDIRNSFDSRFASSSNFSSLNLDCVRQREDLSLIDIEHHSSIRPDLMRRNYEYAVNLYNVTGYTVHPFIFYTGDLPVNKIIRMNDFNTFQPQWFILKEKDGMKSLNNINYKTFNKIDWNVFDAIDFAWIPKFDIDMSIEDCIVELAEIYKMMPADNKFLQFCRESLKLWTGKYIKDKERLDKVKECLNMSELEEIPFEEQLRGVILEGELERAKLKGEEKNRIDFISKALKHMSPKEVSNMFELPIEYVDEIANSYSK

SEQ ID NO: 7539 - protein, 511 aa, Methanobrevibacter ruminantium
MYAINMEQNKKELNIPDEIKIFDTTLRDGEQAPGIALTVDEKIKIAQRLDELGVNVIEMGFPTVSSGERKAAREMVSLGFSSELCGLARVVQKDIDALIDSDLSYAHLFIGTSPLHRDYKLKKSKTEILSQSMEMVEYAKDHGLKVEFSAEDATRTELNYLIEFYKGVESAGADIINVPDTVGILVPSTTRTLIRTLRKKINLPISLHFHNDFGLAVSNSLIGIEEGANQAHCTINGIGERAGNTSLEELVVSLKIAYGANLTVDTTKLYDTSNFIGSITGIKMPPTKPIVGDNAFAHESGIHVDGILKNSSTYEPIAPEIVGHKRRIALGKHTGHAAIKSKLEEFNIEVTQKQFDNIYNQVKTLGDKGKCLTDDDLRSIAITEIGTSGKEYIKLLGLSVMTGESVSATATIKLSIDGKIMETSQIGVGPVDASVLALKTLVQDRVNISLDEYRLEAITGGTDALAETFVVISDDKGNKATGRATREDVILSSVIAVINSINRILDIQENC

SEQ ID NO: 7540 - protein, 221 aa, Methanobrevibacter ruminantium
MKFDPHIHSVFSGDSRSEPIDILIQAQKIGLDAIAISDHNEIKGSRLARSIPGDIIVVPSIEISTEKGHMLGLGVDEIIPKGLSAVETVDRIHDAGGLAIVPHPFSYYRHGLFCNVDSNLGVDGVETKNARYIFGYSNKQAQTLAERKRLARLGASDSHFLESIGDAYTEVNTKGYDSVDGILKAIKHRRCRAMGHGTSNFLVAKEVFVKKVLRRYPKRDE

SEQ ID NO: 7541 - protein, 358 aa, Methanobrevibacter ruminantium
MKILAIDVGTGTEDILLYDTEKEIENSMKLVIPSPHLTIGQMISESESDLYFDGVIMGGGKIKDRCLEHMEKGYKIVFEELSGKTIRDNIEQVKSFGFEVVKEGSFDKELNEDSSLKYADYQKISLKDVDVDKLIDIFKSFDLDLEVDELIIAVQDHGYSEDMGDRDFRFEKIKEKLPEPLPPEVFAMEREEVPEYFTRMQSVIQSLEESNPEFKPVLMDTKFASLAGVCYDKEVLKLNSFIVMDIGNGHTTVASIENGKIQGVFEHHTRDLSPERFEELVLALADGTIKHEDVHDEGGHGAFALNPISKIEKVVVAGPKRALVEKTNLDYYHAAPGGDVMMTGTVGLVKSMEYLRKN

SEQ ID NO: 7542 - protein, 433 aa, Methanobrevibacter ruminantium
MQYRIDLTNDEVPTKWYNINADLPVELPAPKNSEGKDQISTLPQIFVNECLNQEFSTERYIKIPSEVRELYQRLGRPTPLCRARGLEEKLNTPAKIYYKREDTSPTGSHKLNSAIAQAYYAKKEGIERITTETGAGQWGTALCLAASMMDIECTVYMVRVSYDQKPFRKTIMQLYDGNVHASPSENTEVGRKVLAETPDTPGSLGIAISEAVEDALKYDDVKYTLGSVLNHVILHQTTIGQEIKLQLEKAEEEPDTMIACVGGGSNFGGSLFPFIKDKIQGNSDTEFIAVEPSACPTLTEGEYRYDFGDNMGFTPLLKMFTLGHNFVAPSVHAGGLRYHGMNTQISLLKNEGYITPVTAHQRDVFAAGKMFAMCEGVIPAPETNHAIKAAIDEAKKCKETGEEKTIVVNFSGHGLMDFKGYASYMDGSMENSK

SEQ ID NO: 7543 - protein, 258 aa, Methanobrevibacter ruminantium
MGETIAVMNQKGGCGKTTTVVNLATSLAAMGKAVLVVDMDPQANATTSFGINKTEIKKTVYTALVNECSVQKATIPTRIENLFLLPSNIDLSGIEVELSKEDNYHIALKKLLEPIKGIFDYIIIDLPPSLGIITINSLIAADSVIIPIQAEYFALEGLADLMNTINLVETRLRSPTPIKGIVLTLYDARTRLGREVYGELKNYFKGKEYIFKTVIPRNIRLAEAPSYGKPCIAYDPESKGSIAYLKMARELLKLDGEI

SEQ ID NO: 7544 - protein, 248 aa, Methanobrevibacter ruminantium
MAKKQNSGLGRGLDSLIPKIKEIEQDVEEGLSLEDLLKKSDDEEEIEETVEETVEEEAIEEQEDISTEETETEEEPDEEEDEPVVEKDETEEEKIEIEDEPKEELETEAKEEETSNYTNIFSNDDEIVTENSTKTIEISSSKNNDKNIESSVNLNKETEESIKINEDKTKENDSDSVLSEKEEKLVYEVIETVEKNPRITLWSARSAAVLRYLRKTEPEFSISNEASNLIDEAIAQKYPEIWTLFNHL

SEQ ID NO: 7545 - protein, 252 aa, Methanobrevibacter ruminantium
MKLGFSLLSLFMKEVDEMLEIAVENGFDSVELLAEGPYRQDILLERKEITETFHSYDLDIYIHGVNVDINLASLNEGIRKESVKQTKECLDLADEIGAIGVTAHPGKIGRPEKYLREMALGFLTESTHELVAYAEDKEAKISIENMPERFSYLGNRAYELENLTNETGCNITIDLGHVNTCKDQLSFFEIPNILYYHINDNDGIKDKHQAIGDGTLDLNLLKYVDNGIIELNNFDNVLKSKKVIEDFLAKNQ

SEQ ID NO: 7546 - protein, 268 aa, Methanobrevibacter ruminantium
MIKMTKKAIVFDNSGTLLERFRVIKDLSTGEFITHVNSLDLIDSCLNAALVVLQFNTNRLKDLDPNTLISDFVLENNIDFDISYYSTDVSKEEIKAILEKDTAIIKDITDTFPLLKERVPGMELCNGSAVIIDIEEERISYTITSAGQLFSGVKDTIAKLQDSGTDVFIASGDRSGDIRKLANITGVPEDHAFATASTDRKAEIVANLQDEGYKVMMVGDGPNDILAFQKADAAVLTTEQKDGDFPDKLKSYADFVIEDISEVLQIDF

SEQ ID NO: 7547 - protein, 316 aa, Methanobrevibacter ruminantium
MHLDSPLKIKNICLSNRIVMPPMAREESIDGKVTYPLIEYYRMRAKSTGLIIVEHEYVREEGKSSPKQLSMADDSVIDGYIELTESIHREGSFAIAQINHGRYGSISSNNVNLNGISIEEIEDIKKAFVEAAVRSQKSGFDGVEIHAAHEYLLNQFYSPYTNKRTDEYGGSLENRMRLHNEIIREIREAVGDDYIIAIRFGAYDYLEGGSKMEDIPAAVKSFVESGVDMIDISGGLCRYQNPYSREPGYFKDLSKIAKESCDIPVILTGGVKKAKDAERLINEGYCDLIGIGRALLMDGDWSKKAIRKVRKIKSDK

SEQ ID NO: 7548 - protein, 93 aa, Methanobrevibacter ruminantium
MRARERRARLMSLYIYIVMTMIQTKVSARNQTTIPSKIRKKYNVQPNDIVEWKENRNGELTVTFRKRISFRDMIGKGTIKTTTNALDLEKDLY

SEQ ID NO: 7549 - protein, 352 aa, Methanobrevibacter ruminantium
MFEKRKIKRLSNHLNNSYDAEDYVSALSYCDMILDIDSNNPHALFNKAKILVIQGELLEAMSYYKKALQTGFFDMSTWVDEVSYYMDGDISSTNYKLSNRNEISLELCEICLEKYAKDIFFSIYKSQALDNLGRFEESLNAISLDLTPADGELYVFQCIGQCFPLSNLNRWEDLLETSSNGLKLKSEDPSLNSFKAKALYYLNRLNESEGFFNKYIQLTNDSRAYNFLSKIEFKRKNYTSALKLINNAIQLSKKEHLDLLESNVLIEDDGIYENDYYMKSLILLKLNELDKSNKIIDCLMEKEESAKNYCLKARILYEMKDYRTSLSFVNKSLDLKSDCSEAIELKEKLGEF

SEQ ID NO: 7550 - protein, 372 aa, Methanobrevibacter ruminantium
MFTKIKINKLFKELDSALNNQNFDKALIILNNILILDENNLGALYKKALILYNKGEYEKSLSVLDHLLSIDYCIDAFLLKGRVYCNLNDYENSLNSYKEASINFDLDKMNNEMTYYASHPSLFDKGIHTKIFIDLCNIILDNADIIEVRLFKSYVLSEIGRSRDALNNVNYILAHNPNNEKAISLKSSILISLNHFDEALALINEGLNLYPNNLQLIDTKARLYYALSDYDEALEICKEYNSMDDFGNYYLLSKIEYKKGDYSLALKNIDIALDKFFKNPNFDDKKEFSHAYYWYKSLILSKLDRFDEANKICDCLIEKEESAKNYCLKSMILFKEGNYTDALIFIDKALELDCECDKALELKNNIEDKLSS

SEQ ID NO: 7551 - protein, 467 aa, Methanobrevibacter ruminantium
MKKGVLMNILEKLNAIKNQEITAKENVESYIKVIEEKNDELNAFLELNKEDAIAKAEEIDAKIKAGEEVGALAGLVFGIKANINVEDLIISAASKTLEDYIGSYDATVVKLIKAEDGIIIGINNMDEFAAGSSTETSYYGAVNNPAAPGRIPGGSSGGSAAAAAAGMCDIAIGSDTGGSIRNPSSHCGVYGMKPTYGAVSRQGLLDLSMSLDQIGPMARDVTGITLALDTIVKYDPTECTTLKWDAPNFTEIALSVKDKEKPLEGMKIATCKEFKEVTNDEINEIIDESVAKLESLGAEVVELSFDYIDICLPTYYLINYVEFFSATRKYDGRKYGSRIEEVCGPEVLRRIQMGSYISQKEFSGKYYQKALQARSLIRNAINDMLEGVDLIVGPTVPKLPHKLGEELEPMEMYAYDVLTVIANLAGIPAASLKAGEVDGIPVGLQLQAKPQDDAKIVKAMAAFEYAQ

SEQ ID NO: 7552 - protein, 189 aa, Methanobrevibacter ruminantium
MMSELEKLKSGLVYCYDDEEVSAIKDNAIYQSFRYNNIDPNDKQKQYDALEEILGSCGDDVWIGKRFSFDNGKNIHIGNNFTGNYNLTILDIREVYIGDNVMIGPHTLITTVGHPLEPKGRRKHLAMADSIHIGDDVWIGGNVTILPGVNIGNNVVIGAGAVVTKDIPDNSLAIGVPAKVVREIENDIE

SEQ ID NO: 7553 - protein, 287 aa, Methanobrevibacter ruminantium
MTDNSSNMGSNSDKKEFDSDRKEFNSDKEFNSKKEFDSKKEFNSKKEFDSKKKDFNSKKFNSNYKSNRSRNNINTIQDLKNSIELKENKINDLKELLEIKDEEKQEVEYELSLKDQELNDLQSKLDILTVENEELTIELNEKESKISKLNNALVKCKYEKDKVDLVLKNEVNIEKSRLKEMDNLNNTIKEKIAIIHDKQEQINYLRTLIDDYKDQTKNNTDNLDLQLKKITKTYEGLLNQKDSIIEKQEQNINELIESQKQIAKDNKATITRLELEIGKYREELKKS

SEQ ID NO: 7554 - protein, 129 aa, Methanobrevibacter ruminantium
MIKMEITGIVTTGLGKAAYFLGQDFYKSQFNEKCGFTPFPGTLNLIVEENKLEDIRLMKNSCTNVIKPDQGFGGVKHIRAYLNENIVGAIVFPDKTTHDENYLEFISKDKLRDKYNFKDGDEVVITIDI

SEQ ID NO: 7555 - protein, 569 aa, Methanobrevibacter ruminantium
MSWLVVLIVFLLASIKSTKNPSVSVVIPAFNEEATVAQVVTVARKLSYISEVIVVDDGSTDKTVEEAERAGATVISHKGNQGKGVAIKTGFKNSHGDIVAFIDADVSNFTPTKIDKIIKPILEGKTDITKTKFARESGRVTELTAKPLLSFFFPELNYEQPLSGQFAGKRSALNKIKFEKDYGVDVGIVLDADVHGISILEVDIGDIQHDMSSLADLNKMANEVVRTIIDRAVDYGRVTMMDTLGNYIRMAIMGLSLIILGLFMIFFVPFIPLVISVLVALVGIALTIAYIIKIVQRSIPILRKGDTSTALKSFVKMHFPVIVSGLILILMLSTFLSAATFNDGRISVELTSRNFVYSPSDDYHQTISVRGPYTIDSAIENETDMVRIPPDALSTLEMSANDTMIIDGEYYSVNTSREGEVDVFRLSKAVRHDLDLYPREVIPNSRLAEVFNGVIVNHNINFNNSSEVMEGYVQFSISPKATNATFFNLTLDNESLLSSVGNFKNDSYYTIAYDDDILCAFTGDDIKKGNVTFEYAGKDGMIVFEDRNNTSIRNFIDSDRDSFVKLYTL

SEQ ID NO: 7556 - protein, 3079 aa, Methanobrevibacter ruminantium
MSIKRILLTSLMLFIIIFSISFVSANENVTNDVSTNELSTQTVSNDITTSESISDTSLDSGENRGLDEIKSNSTEESSSSNLDLEDGTLNNDEIESDDCLTKNGKEATLQANKLSLDINMSRGTAQDVLDAIVRISSQGGGTLYLNGGTYTEGGHARVYNNDTDSFRNIVRNDGIVDISNVRVVGGSVDNPNQYATFQPNTRDSTSLAFSGYGVWDGNGTRYYPDSGFNLTNVTFENLNCTGRFFSFNSGYLTDCVFNNLESYQHLFFVTGAYNDGGKPIVLTNCNFTNSKQTYRGDGPGDGTDGTGQFGVVFGAEMYGCNFINTSTATHGGAFCLSDEWISAACVPSKLVDCNFINITSRWFAVYIHGNYSNTTRFITEPQVVENCSFINCTATGEFGGALGISHNNVIINNTEFIHNVGGKGSAIMVGGINNTHDGFLGVNTQGNNITIYNCTFEDNIAKIEGQSSAHSTDPPFTTYPTGYGGAVYVYGNHTKIIDSTFNNNTADDSCGAAIYIRGDNTTVVNSEFYNHTSENGTIYLVGNDCKIKDSLFHDNDADSTGACIFVEGNRAEIGNTTFVNNTAPNGGCVFIIGDHTLVDNDTKFITNNATNGAGIYVNGSNTMILNTSFINNTAVNGSGAFIYGHDTDVNGSYFEGNDATNGGAVFIEGNINDISNNTFLRNNATNQGGAVYIDGNHTKVNYNNFTENEAIPISEDQETGLGGAIFIRGNDTNTTANTFLHNKARNGSAIYTDGTNFYLHNDHFLENQAWSYLLITTADPAESLYKEQDIEINVLYRAGDNIINAIHNRNKPNETHFMNVTYSHSEFGNITTSPADQYVEPVDGVENSREGELLYQDDRENYQQIELRVEHENGDLALPRTPFRTNIYGNVNTTLNKSSLRKGLYVVGAEHIEDWNYKFIMNSTSFRILDTMDIMVNKTSDKEEYFQDEIAEWELIFHNTDNGTDAENVTMTDHLPNVFELMNLSYMFYTPTEAITNATLYLNNNTLRYGVYNSSSQQWVYGDARYNASANSWTYYFFDYDNVTYVYTEFNADDFVPVFGPVIYSNSTDVCYDNISYNIPEEDWYYDTIMVNGQEVRYGHFNATEFEQYFGPSYYDEDNKTWVWIHRGEDPLNPGQETDLRTIYDPESNIWVIDDYMHYPERKTVTEKVVFTIVNDTANNLTHLSLYARDFDVNVTGYVNFTTNCTRSGDYTNVVNVTTPDYDWDLSNNVANRSVLVDPLPNKTVSNTTPYYHDYVDYNLTIMNTGNSTYDQILTVVDSLPEGLVYNTTVGILYADQIGETLVENQGRTVTWNVTNIPANTNATIIVRVYVDALGNLTNNMTLIAPSGDNRTVNATITPVTYTDVSVNKTVEKEEYFINDTIVWTITVSVAGNGSNATNVNLSDVLPPEVEYISTNGTYDNATNSWYIGNMTNGSSVSITIDTRAIRVAENVTNVANVSCNETEWDYENNRDNATVSIIPVPQKTVNETNPTFGKYVDYNLTIINNGAEPYTDTLTVVDNLPEGLAYNNTVSILYADQVGDTIVENNNRTITWYVTNIPANTNATIIVRVYVGILGEQINNYTLIGPKGSNRTVNASIVVEPKVDISVEKTSDKINYFEGETVIWTITVSNANNATPATNVTLKDILPEEVEFVSANDTYSNETGIWYIGDMANGTSRTIVINTTAIRSKTNVTNVASVNCTEKEWNYTNNVDNATINIYPLINKTVSNSTPDYGDEVEYNLTVINTGDVMFNETVTLVDRLPEGVDFIKVLNEDGLKVISFDHSTKNLTWVVTNISANTKATITILANCTLVGLQENTWTIYGPEGMNRTVNATIVVGPKVDVSVEKTSDKINYFEGETVIWTITVHNANNGTNATNVTLKDILPEEVLYVSSNGTYNNNTGIWYIGNMTNGSSRTIVINTTAIKSKANVTNVANVSCNETEWNYTNNVDDAVINIYPLINKTVSNPTPDYHEEIEYNLTVENTGDIMFNETVTLVDRLPIGVDFIKVVNVTGLKVISFDNTTKNLTWNVTNITAHTKATITILAVCNAIGVQDNTWTIYGPEGMNRTVNATIEVKPIVDVSITKVADQEIYHIGDNVTWIITVHNAWNGTNATNVNVNDILPKEVEYLTHTVTQGQYNNRTGIWTIGFMANGTSQTLTIVSVAKINKTDITNVANVSCSEKEWNYSNNRDYATIEIVDTPINKTASKPVPDYHEEIEYYLTVTNLANETYNKTVTLVDSLPEGVTFLRVVNETGLRVLGFERRGNHQIWNVTDIEPNTTAVITILARCDAVGTKINNWTIYYPNGDSETVNATIEVKPIVDVSITKVADQEIYHIGDNVTWIITVHNAWNGTNATNVNVNDILPKEVEYLTHTVTQGQYNNRTGIWTIGFMANGTSQTLTIVSVAKINKTDITNVANVSCSEKEWNYSNNRDNATIEIVDTPINKTASKPVPDYHEEIEYYLTVTNLANETYNKTVTLVDSLPEGVTFLRVVNTSGLRVLSFNSTEKVQTWTVTDIEANTTAVITILARCDAVGIEINNWTIYYPNGDSKKVETPIDVQPIVDLSTTKTSNKDVYFLDDTAVWTITVHNAWNGTNATNVVIDELFPSEFEIINYTTTKGRYDPSARAWTIDFMENGTTETLVITSVATVVTPFVDNPVNVTSDERDWNLSNNPSNKSVKVIDIPDPEKTVNNATPYYNDTVVYSLTIKNTGDIKYTNKLTVIDSMPQGLEYVKTVGISGAKLIKEVVKGQVITWTITNISAHSNAVIKVRVRAKALGNLTNNLTIVTPHANKTVNCTITPVPIADLAVTKTNDHYGKDCLNSTFVYWTIKVVNYGPNTAVNAIAKDILPEGIIYLSDDSDGAYDYETGIWTIGNLAKGKSVTMTIETIVDAIDTRINNKVVVSSDTYDPDKSNNRDNSSIKVISIADLKLTKTANVTKTYVGENFTYTITVVNLGPDTAVNSRVYDVLPKGVKLLSFNESKGSYNPQTGKWAIGDMALGEEVTLKVNVRALTTGKIVNEARVESDTYDNDTSNNNDSATVIVIGDNPPIKMLPTGNPILIALLSLLAIVGVTLRRKS

SEQ ID NO: 7557 - protein, 728 aa, Methanobrevibacter ruminantium
MMIADTLSQELNIKISQAESVIKLIDDGNTIPFIARYRKELTGSLDDEVLRKFDDRLKYLRNLEEKKETVLNSIEEQGKLTDELKQSILDCKTLVELEDLYRPYKPKRRTRATIAKEKGLEELANIILAQEIEVPLEEIAEDYITKDDSVEEELRVNTVEEAIGGAQDIIAEIISDNASFRSLIRELSYEDGELISEAKDKDADSVYDMYYEYSEEVSKIASHRVLAINRGEKEKFLKIKISAPEEDIISYLTRHVLINKGGKPTKPIYNKYTEETLKEAIQDSYKRLIAPAIERELRNQLFEKAEDKSIKLFSKNLEQLLMQAPIINKVVLGWDPAFRTGCKLAVVDEYGKVLDTTVVYPTEPQNKIAETRSTVRDLIFKYDINIIAIGNGTASRESEAIVADIIKDLDVQYVIVNEAGASVYSASELATEEFPDYNVGERSAISIARRLQDPLAELVKIDPKSIGVGQYQHDMNQKKLGESLDNVVEKSVNNVGVDVNTASVSLMEHVAGISKTVAKNIVSYREENGKFYTRDELLNVKKLGPKAFEQCAGFMKVKGPNPLDNTTVHPESYGATIAFLSFLGYSIEDLENKKIKESDLDLTDKQFEDMAQELGIGSITLKDIAKELKKPGRDPRDEMPQPILRKDVLTMEDLEKGMVLSGTVRNIVDFGIFVDIGVHQDGMVHKSEITDSQYVNHPMDFVSVGDIIDVKVLDVDIPKRRIQLSMII

SEQ ID NO: 7558 - protein, 1224 aa, Methanobrevibacter ruminantium
MKTRVSVIIPIYNVYEFLEECLESVVNQTINDMELTDGYERNLQIILIDDGSTDSSPIIAKEYAQNYENIEYHHEVNQGLGHARNYGCEFAEGDYIIFLDSDDKLSPNAYEWMYKTAIRNDSDMTIGGFWRFNSKKYKISNINKIAFNGNKEKTHISESPELFYDTTAWNKLIKHSFWKKHNFQFPEGILYEDIPVTIPMHFLANNVSIVYENCYLWRIREGKSKSITQTTTEIKNLEDRLYVMGLVDKFFDENVDDERLRHVKTMKWLKTDLLIFIRKLRSMDKEQGYKIMSLIRDYIQNNIDADEFKYLNEYERLKYEYLMDDEIDKIVSILNFKAENIKETKVYQKNGHIMFNADKEVFKQSPFYIDQYIRERYNRKYIQDIEIRDDGFLIRGFMLIPGLDIKNFKDREHRFHLTNANSHKKIKIDSEDVETGNISSFNIRFGRGFSYDAAGYKIFIPFSKICDDEDFFGENRISVDFKLNGIYQSPFLSYEKKELCQNFFLGYAKKDIRQKTNMKAVIYKNTYFLIRYTLKDEIIIEALPLKNYFKEIRLDENVLKLDSDHIGNLYIYYEADSINEEEKIAFEYDNEDKSYQIDIRKLKKKPGKILCDGENSIYKSKELILLDSKYGQCLISTLNDYYLDIYYFDSLTQVLDIRQNRDRIDIDAKLYSNRFNETRSTYKADRIKTAKLYFKDDSSKENYILSDGMIDRQTGDIKFSIDFSNKEITKNLYEKIHDLYVEYAYDETSTEEEAIVNKEVDESEYDSVSKEEKENNKIEKTENEPVPVEGRNNKINEESRFSTELYLFKGDDKTISKSYYEYKVYHDLKGFLKLKVLKRWPVYEDTPGKRLKHSQISYKLFSKLPINKKRIMFESIWGGKYSCNPRYLYEYIDENYPHYECIWSFKDEHYPIKGNGKCVRRSSLKYLYYLATSKYLINNVNFKKHFIKRKGQVEIQTMHGTPLKTIGLDAPGEFPTKKSQKDYIKKNKNWDYLTVQSDYVAEISRTCFKYEKDFLKFGYPRTDILYTKNNKEDIQSIKERMGLPSDKKVILYAPTWRFKNNFDLMLDLKSFKESLKDEYILILRLHHFSAGGWKQPLDDDFVYDFSGYGSIEELYLISDILITDYSSVMFDYAILDRPIILFAYDLEEYDEKLRGFYMDIESNKPGPILHSSKEVEEAILNIEKTEMKYKDLRRSFKERFNQYECENSSEKIFNKVIDKKKNKK

SEQ ID NO: 7559 - protein, 97 aa, Methanobrevibacter ruminantium
MNWVVIPEYSLIPSLNWFITDFLGTCCRCGVDIFLMLSGALSLGRDWDIKSFLGKRIPRITYPYLFWATLLISIMLVAVYFNPDLLKLFFGISHSFI

SEQ ID NO: 7560 - protein, 335 aa, Methanobrevibacter ruminantium
MMIPKVMIILGSASDKDIAMKSIKILEKLQIPYSLKVASAHRTHDKVKKLVKDATDKGVEVFIGIAGLAAHLPGAIAAYTHRPVIGVPVDGAVGGLDALYACVQMPFPTAVTTVGINRGDNAAILAGEIIASYDEKVGQNISDLRVEYQEKVEAGEKELIESIEGEYFQKDFLEEEKYEKIEFEELDDTPDVMILAGSYSDMEIAKNVAILLERMRINYKLDYISPIRHAKDFESYMSKRNNAKIFIAISGLSALVAGSVVALTEKPVIGVPCSKKLNGQDALLTMANMPPGVPVGTVGIDNGRNAAIVAGEILAISNKEIEENLKWIKYKNADL

SEQ ID NO: 7561 - protein, 420 aa, Methanobrevibacter ruminantium
MAEELNIIQIDEELDAEYEAAKVLRKYPKDTVMLNNIKGYDIPVVSGICNTREKIAQSLGCQVDEILYKIIDGMNNPTPITKFIDLKDEYDSKRVDLGKIPILTHYKRDGGAYITAGVVFAKDPETGIQNASIHRMLVLEKNKLAIRIVPRNLYTYFQKAKDMGKDLDISIAIGMEPSILLACTTSIPIDADEMEVANRFKNGELELVNCKNGIKVPEADIIFEGKILIDETAPEGPFVDLTDTYDYVREEPVIKLSKMYLKKENPMYHAILPAGFEHKLLQGMPQEPRIFNAVKNTVPTVQNVVLTEGGCCWLHAAVSIKKQTEGDGKNIIMAALAAHPSLKHVVVVDEDVNIFDPQDIEYAIATRVKGDDDIIIVPKARGSSLDPKASEIDGTTTKVGVDATKSILEPHKFERVSFSE

SEQ ID NO: 7562 - protein, 350 aa, Methanobrevibacter ruminantium
MKESSFYIKLYEENNSTDHISNSNKSVQCNLCARECKIKNNNTGFCKSQKNIDGKLFALNYQRIASYHIDPIEKKPLYHFLPGSSTYSIGGFGCNFSCLNCQNYMLSMNSYNENNSIKILPERIVKNALDNDCLSISWTYNEPTLYFEFAEETSRLAHSQGLKNVFISNGYMGEEVLKETVSFIDGFNIDLKFFDDELYRKICGGRLDIVLDNLRTIYESKKKYNNHLEITTLLINDLNTEKEHIRAISRFVLDELGPEVPLHFSRFFPMYKMTDKAPTDIDYLIRAREIAISEGLEYVYLGNMPADNNTYCPECGELLIERNRYCNRDKNRIKDGCCVNCGHELNFVFD

SEQ ID NO: 7563 - protein, 413 aa, Methanobrevibacter ruminantium
MKSTLKVSDIGEKQLIERIIEKSKLCSLKNPFDLDDFNSNYPSSNFKTSIGDDSALLNQNLNTNHYLVASSDMLIQSSHFPREMTYYQMGYKSVIVNVSDLASMGAKNIGFLLNIAIPKDTSLDNFDDLICGIIRACDNYNIPLVGGDTNEASEIILSGTAIGQVEKGKALMKHGFKEGDLVSISDHLGYAALGFELLKIKEENIDKYNDIIFQINKIDPTVKDLALFKALKPEAKYEEGRILASHNSQENRISATDITDGLASEFYEILNADKKYYLFNKDTESHNPNDSNDSNDLNNQQNNQNNTNNQDVIDEYDDSNYSKGIRIYEDKLPVDDEFKQIADVLGIDYLDLFLHIGEDFELLFTINKELKSQLENDMNFYVIGEITNNNTVEIVLSNGDIKNISSKGYEHLK

SEQ ID NO: 7564 - protein, 227 aa, Methanobrevibacter ruminantium
MNLIKGLDKNNGLDLILHAPGGDVGATESIIDYLYEVFNGDIRVIIPQIAMSGGTMIACSSKEIIMGKQSSLGPIDPQFNGIPAEIVIKEFYRAKNEISEKPETIPFWQTNISKYPPAFIILCENARKWSDEILDKSLRYAMFDGSDEEKINKIRLELGSHENTKSHGRHLSAKDCQELGLKISYLEDDDEFQDTVLSIHHACMNFFSINKDCCKIVANNDSKFFIQ

SEQ ID NO: 7565 - protein, 55 aa, Methanobrevibacter ruminantium
MAVEFNEVIKMNESYVKRLYRDLGIPYYRPKKDKGDEEFDFFPKYDLMHWIPLKV

SEQ ID NO: 7566 - protein, 106 aa, Methanobrevibacter ruminantium
MFKIRKLSNKIIVLLICGLLICSIQACSASCTAVYVGPDVSADGSTIIARCNDHQGVWGNHITVTPRVENKSSRLMAVCEDGSVKTELPATTYKYTATPYMNSTKA

SEQ ID NO: 7567 - protein, 153 aa, Methanobrevibacter ruminantium
METILTNEKDERFIELSNELNNEYYSNIGEDSLKYLDYNTLEDPHVVLLVLNWGNPIACASYRIFDEQSVEIRRVYVKKRYRNKKIAYKLVKALEKLAMENNFKYSIIETGSENMAAINLYKKLGYEKIDNFGFFKDDDACICMRKEFKTLIF

SEQ ID NO: 7568 - protein, 155 aa, Methanobrevibacter ruminantium
MHQKFMEEAIKEAEISSKEGGLPIGAVLVKENQIISRGHNRLIQKDSSILHAEMDAIENAGRLNHEDYQKCTLYTTLSPCPMCSGAVILYNIPRVVIGDNQTLMGAEKLLKDNGVEIIVLNDDKCKELFEDFVNNNPGIWENELAKVGNTTELKE

SEQ ID NO: 7569 - protein, 322 aa, Methanobrevibacter ruminantium
MIIMSEDTAVLLLSHGSSLPYAEEVFKDICAKFKEQTEFDAEVGYMKVAKPSLPEAINILKERNPGLKRIIATPVFLAPGIHTNIDIPIILGLEPKETDPRQPDGNYPEGHYLYGLEEVDFDGELKLIDAIGPNPRLIEIINNRIDTALEDSKLDDDAKTAVLLVSHGSRLNYNKEFISCVFQQFEEQTDYVCDFAFMELVDPNIPTTINKLVSENEVDRLIVVPVFIAPGVHTTRDIPTILGLIEDDGSGHHHHHHHDHDHDHSHDHGHDHDHGHSHGHHHHHHAHGDEKMEFDGEILYPEPICDDDILIEILETMVKEAL

SEQ ID NO: 7570 - protein, 132 aa, Methanobrevibacter ruminantium
MSDTVRTWRHIQQRYNLIGSKCTTCGQVFFPQRVICPECRRKGNIEDIQFSGKGKIHTYSVIRTPTSDFKKIAPYAVAIIELEEGAKVTAQIVDADVDDIQIGDPVEMVFRKIREDGPDGVISYGFKFKIVK

SEQ ID NO: 7571 - protein, 338 aa, Methanobrevibacter ruminantium
MYSSELILSLILIIFIIGIMANITDSVNEKVLSQEELSSLEAISIESVDYLLNNPGSPMNWEEDEGLNNGIVSRRIIPGLAINKKSVENGFFYEESSSDEEIIPNSISYIKLLKLQSNYDDLINRNLFNSTLKSSITIYPHSDIDIIAMGDDLESSSDVVAINRTVRCDYLSNFVIYRFNDFELYGENYKKTELCNHDSNVNLSNHSNDRRYFWLCKNFRIYRSSLNNYNYYLISDSSIRHANSYYILESLNRTRDDMERLNDEVIELNPFFAEDMVNSSNEIYSIHFKVPHDDIDDFKTVMVAIHKNMTDEIVSNNQLRYDYFNSGEVDFVLKTAYR

SEQ ID NO: 7572 - protein, 144 aa, Methanobrevibacter ruminantium
MSTTIRINKDVKELLKLKSVETGVSQIDLANRYILYGIKYDDTPSKPIKSIEEIEKLLNYDEIRESVEEIDLKDYEYEIPQGISLVKEGEENKPINTEEEIKKILKYDKPEGDDVSRSIAGIIKTEEVTDAVKLKKERLKERYK

SEQ ID NO: 7573 - protein, 130 aa, Methanobrevibacter ruminantium
MIFLDTTYIIALINENDKYHKKALKLMEDVDYEKKMTNSVVFVESLNMLDKRSTQKDIDNIVNKLYQLDKIHCVNSANIKNSLNIFKFYNGSINFADCTIIDSMITYRINEIISFDSDFDKVKGIKRIYI

SEQ ID NO: 7574 - protein, 234 aa, Methanobrevibacter ruminantium
MTTMIEFQNVSREYQSGDHILKALDNLSLKIEKGEFVVILGPSGAGKSTFLNLLGGLDTATSGKIIVNGENIADYDDNQLTKYRAKEVGFIFQFYNLIPNLTAKENIELMSDITNLKVDGNKILDSVGLLDHANQFPAQLSGGEQQRVSIARAIAKQPAMLLCDEPTGALDSNTGVLILSLLQTMCHEKNTTVVIVTHNAKLADAADKLIRIKNGQIEEVKINENPLDINEIEW

SEQ ID NO: 7575 - protein, 202 aa, Methanobrevibacter ruminantium
MPSVKDILIEMKDMSELMVDLAYSAVLFNNRAAAEEVITLENKLNSMNYEIKKQSLVAARSLEDAEKLTTLLEIAEAAESIGNAAKDLADLTLKGFEPHPVFKMVMEESEKTIIRLNVDESSVLVNNSLGDLLLLNRTGMRIISIRRGDSWIYGPDKNTVIIAGDVLIAKGSEAGTEIIEKLAEGEMDLEDLVNMEDFIDDN

SEQ ID NO: 7576 - protein, 454 aa, Methanobrevibacter ruminantium
MMIHLIGIGNDKGNITLNAFKAIKEADVIINYNDIDLSFFDSEIKDKEIISAIDLINDIDLEDDLDLNDDVAENIDSDEDLDSEINSDDLESNIISDDLESNIISDDLESNIISDDLESNVGSDDLESDIDSDDSSDIDLEDDLKSNPLLERILQENFLIELAISKSLESKQVALIVSDDPNILGLSNRFLQIKSKYSDVKYKIYPGVSSISQSASIVGAPLGDFALIDLSNPITSLSEIEDKVKHILDANLVLAIKNPIDDKREDGREAYNLIKSIINEYNDELLTAIVYSDGYYSIDEFKNIYDEDIDENSIFFIGNKLSYILEESMVTSSDYIVETKLISWSIEFFERYLNGEVPRGLDYDCDFLPCHVNLEACDFCYCPFYPCADGVTGGEWIKDRDVWSCQHCDWIHLEEPCVAIREGLDDILKEIDDLKDKHIELLKLRRKSLLKTLK

SEQ ID NO: 7577 - protein, 657 aa, Methanobrevibacter ruminantium
MTAETLLKFARKGIILTPGAYDLILGSDNPLDLSSSIILKLKSGKYSNEDLVPVDEKQIKEMMKALGISVKENKGLDHGSLDDFGSRTSGEGLERKIETRPEKTVEKAVEPQQAVETREQKPQQTFKPTQEKTVEKPIEKPQQTFEPNQQRTVEKPIEKPQQTFETPAKQTRAEKPIKPQIKPISAEKPTEAPQRQETKEIEKTIEKPKSDKPKVNAGYPSDHIVKIDNVEVSEETKKKYRRNLTESKVNFDGFKVLKDTSNKSYTSGEIGNLIEYFQNRYKKLSDILSKRPELRTWQKINEITETQTDLNLIVMITDIKSTKNGHYFIEVEDDTGSMPILVSKDNDQLIRAAKNLMKDEVIGIVAQKRPGNELAICQNIIDPGVPRIAKKEVNFGTVFTSDIHIGSSTFLEDAFTRFIKWINGDFGSEEQMEMANNVKYMIIGGDIVDGIGVYPNQDKELAIKDITAQYDEAARLVGDIRSDVKIIITPGNHDASRVAEPQPAVPEKYAKSLYELNNVEFLSNPSMVSLDGLEVLIYHGRGIDDMVMGSNDFSHERNDLVMKEFLNKRHLAPLYGERTPLASELEDHLVIDRVPDVLHTGHVHINTYTNYKGIHCINSGTFQTQTEFQKIYNIVPTPAEVPIIDVGGNYKQLKFID

SEQ ID NO: 7578 - protein, 195 aa, Methanobrevibacter ruminantium
MEKEIVKSVVEMSAYVFERGLVSGKAGNVSARFKTDHGDIVAITPTLKSLADLEDKDIILVDSEGNNLTKGKPSSELGMHLAIYREKPDVYGIVHTHSPYATGFAFSNKRIKRLEGFGQIKSEYIKDIDYYKPGSEELAKNAAEALKEEDVIVLRNHGVIATGSTVKEAATLVEFVEESAKTQFVTLVLNSLDEK

SEQ ID NO: 7579 - protein, 163 aa, Methanobrevibacter ruminantium
MKIEFDTIGTIHSPFKELEGMPIQPTGAKGIKGEIHIKDEYKPGLKDITGFSHLILIYHLHKTNGNALEVKPFMDNKTHGVFATRSPKRPNNIGMTVVALDSVDDDCVLHISNVDILDGTPLLDIKPYVPQLHEDTIVDLRIGWFETNHKKAKTQKADDRFIN

SEQ ID NO: 7580 - protein, 82 aa, Methanobrevibacter ruminantium
MTNETFEEVSQILKHIMENPSVPRNIRRAADESFNTLNNEEEDETVRASAVIIKLDEISNDPNIPVHARTLIWEILSKLEAI

SEQ ID NO: 7581 - protein, 118 aa, Methanobrevibacter ruminantium
MVKNEKFITVICFNKFHGKKIFKIGSILKLVKEPDNAYDAEAIRIEMRYAGKVGYLANSVKTVVRGTMSAGRVYDKINDEAAYAQVKFISNENVIARILEEEEIKDLKRDPESDLNFI

SEQ ID NO: 7582 - protein, 335 aa, Methanobrevibacter ruminantium
MSNTEKINVNVESNKDKGFSDDINTIFINFNGLNISLELMEKQSYKNMDIIPIKTDSFAKKDFITLKKGFEMGLVEIKELENEEVNTVICKNDAVVPLILIDGDEIIGAKQNRIMNESLLIPAKSQVKIPVSCTEHGRWRFKSNEREFQHSDYSLNFESRRIKSIARNECRDYQSDVWSHISDLEDRHSFRSRTSSMNDNYEHSKTAQDDYIKNLMIADGANGLICFINGEFKGLELFYNHSIYKEYYEKTLRSYIIEAISYGGNNTVGEELFRVINGEMNDLSSSEFIEYETVGLGKNIRFATKGGSGSGLIFEDELVHMTYFKEDSNKNYEIL

SEQ ID NO: 7583 - protein, 341 aa, Methanobrevibacter ruminantium
MITELYSNSIYMLLTILLFSLAVDLLLGEFPMQIHPVVWIGKIISFFKNILIKYDNKIAGLILSIAVIIVSSLIVLIPMAIARYLLPYNDMMIYLFKLIAILLLTSTFSVKLLLDSARDVEKDLRNNNLNKARQAVSYLVSRDTNELNKEHVISAVIETLSENIPDSYVSTVFYYSIVGIIASLCGIGDFDVIILAVLAAFIHRVVDTMDSMVGYKTKELYNIGFIPAHLDDALNYIPARFSGALIVVSAMFLRLNWKNALFIMRRDANNCDSPNSGYTMATVAGALNIQLEKEGVYTLGDNINPINVDCIEKAVDLARLTIFLVTIFFMFVFMDLILLML

SEQ ID NO: 7584 - protein, 154 aa, Methanobrevibacter ruminantium
MAVIDEEQVREWLMEEDMIREKIYDENANFHYIINFPNNNAMDVIQPRTKEDVLLIGCATEVSQVEQDMIKNTDKAINQEFIWNVRFALNEMLLDFELEHPDDQLKRFIITEDIFSDGLTKHVLVKSIKKVFKAKLQCIWLLGKTYGTVQMKKE

SEQ ID NO: 7585 - DNA, 12 bp, Artificial
  Spacer sequence
ttagttagttag

SEQ ID NO: 7586 - DNA, 20 bp, Artificial
  Primer sequence
tgagaagggaacacctggat

SEQ ID NO: 7587 - DNA, 19 bp, Artificial
  Primer sequence
ttgctcttccgaactgctt

SEQ ID NO: 7588 - DNA, 20 bp, Artificial
  Primer sequence
gtattgcctggtgaagatgt

SEQ ID NO: 7589 - DNA, 19 bp, Artificial
  Primer sequence
gtcgatttggtagaagtca

SEQ ID NO: 7590 - DNA, 36 bp, Artificial
  Primer sequence
aaatttggatccggaatcttaggttaggaggtcaat

SEQ ID NO: 7591 - DNA, 34 bp, Artificial
  Primer
aaattttctagataacaagcaaaatatgaattgc

SEQ ID NO: 7592 - DNA, 42 bp, Artificial
  Primer sequence
atgcatcatcatcatcatcatagaggaactcaaatgtatgaa

SEQ ID NO: 7593 - DNA, 42 bp, Artificial
  Primer sequence
atgatgatgatgatgatgcatcccatctgcgacgataacagg

SEQ ID NO: 7594 - DNA, 25 bp, Artificial
  Primer sequence
ttagacaagttcttagtcgactctg

SEQ ID NO: 7595 - DNA, 30 bp, Artificial
  Primer sequence
agagacaattttatctgccccagagctcat

SEQ ID NO: 7596 - DNA, 30 bp, Artificial
  Primer sequence
atttaattaccatggtgatttattatggca

SEQ ID NO: 7597 - DNA, 21 bp, Artificial
  Primer sequence
attgcaggtcctgttatcgtc

SEQ ID NO: 7598 - DNA, 21 bp, Artificial
  Primer sequence
ggacattccacttattaccgc

SEQ ID NO: 7599 - DNA, 21 bp, Artificial
  Primer sequence
acttatccgaaccggttactc

SEQ ID NO: 7600 - DNA, 32 bp, Artificial
  Primer sequence
aaattttaaggatccaatctgtatgagctcag

SEQ ID NO: 7601 - DNA, 39 bp, Artificial
  Primer sequence
aaatttgtcgaccaattacacaaaaagatgagccgttac

SEQ ID NO: 7602 - DNA, 45 bp, Artificial
  Primer sequence
atgattcatcatcatcatcatcatatcgaaggaaaaattattaaa

SEQ ID NO: 7603 - DNA, 45 bp, Artificial
  Primer sequence
atgatgatgatgatgatgaatcatttaaccatctctaccccaata

SEQ ID NO: 7604 - DNA, 30 bp, Artificial
  Primer sequence
atttatccacatatggacgtcctttcctta

SEQ ID NO: 7605 - DNA, 20 bp, Artificial
  Primer sequence
cctctgaaggatcatctgat

SEQ ID NO: 7606 - DNA, 21 bp, Artificial
  Primer sequence
agcattgcttctgaaggtgaa

SEQ ID NO: 7607 - DNA, 21 bp, Artificial
  Primer sequence
gagtaaacactattggtacta

SEQ ID NO: 7608 - DNA, 43 bp, Methanobrevibacter ruminantium
tttttcttttttttggatgattttcatctttttttgtttttta

SEQ ID NO: 7609 - DNA, 52 bp, Methanobrevibacter ruminantium
ggatattattgttggtaatcagacagatgactgattgttttttttttaagtg

SEQ ID NO: 7610 - DNA, 47 bp, Methanobrevibacter ruminantium
gattgatttcctgctggcggattcattccgcctttttttatccaaga

SEQ ID NO: 7611 - DNA, 52 bp, Methanobrevibacter ruminantium
aatttaattttaagttctagtttcttttgaaactagattttcttctttttta

SEQ ID NO: 7612 - DNA, 52 bp, Methanobrevibacter ruminantium
atttattttttttgttccagtttcttttgaaactagatttttttctttttat

SEQ ID NO: 7613 - DNA, 45 bp, Methanobrevibacter ruminantium
aggaataaggtttaataatttaaaaaattatttttttttgatttg

SEQ ID NO: 7614 - DNA, 45 bp, Methanobrevibacter ruminantium
tacagtactgctctagaagaataattcttcttttactattcttac

SEQ ID NO: 7615 - DNA, 55 bp, Methanobrevibacter ruminantium
ttgtcaccttgtgcagggttggaggtaatagctccaaccctttagtaaattgata

SEQ ID NO: 7616 - DNA, 52 bp, Methanobrevibacter ruminantium
aaatttttatttagggttaagagcaattactcttaactttatttatatttta

SEQ ID NO: 7617 - DNA, 41 bp, Methanobrevibacter ruminantium
tactctttttttctttagttttactattttttttcttagtt

SEQ ID NO: 7618 - DNA, 62 bp, Methanobrevibacter ruminantium
cctgaactctccagagcataatggtatgatttcgcatatcattgtgcttctcatttgcttta

SEQ ID NO: 7619 - DNA, 43 bp, Methanobrevibacter ruminantium
aggaagttggttttgcagaactcttctgttttttgggatagca

SEQ ID NO: 7620 - DNA, 49 bp, Methanobrevibacter ruminantium
ttaaatttattatttgttagccttaaaggctaacttttctctatttttt

SEQ ID NO: 7621 - DNA, 56 bp, Methanobrevibacter ruminantium
taacctttttttttatttatagggataagaacccctataaatttatttaattttaa

SEQ ID NO: 7622 - DNA, 50 bp, Methanobrevibacter ruminantium
ccaaaatttttatcagggctgttgtcgaatggcccttttttatctctttt

SEQ ID NO: 7623 - DNA, 41 bp, Methanobrevibacter ruminantium
tttcctcctattaaatccttaaagggtttttttattcttat

SEQ ID NO: 7624 - DNA, 47 bp, Methanobrevibacter ruminantium
gttattagttcatgattaatcttttagattaatttttttctcttttt

SEQ ID NO: 7625 - DNA, 41 bp, Methanobrevibacter ruminantium
cctacttattttcactatttttaatatttttttatttttac

SEQ ID NO: 7626 - DNA, 49 bp, Methanobrevibacter ruminantium
ttaggtgctttattcggatagattctttctatcctttattttcttttta

SEQ ID NO: 7627 - DNA, 45 bp, Methanobrevibacter ruminantium
tattaattcttattttcagtttcaaactgatttttttattttttt

SEQ ID NO: 7628 - DNA, 45 bp, Methanobrevibacter ruminantium
tttatagttatctgtttataaatattataatttttttctaatttt

SEQ ID NO: 7629 - DNA, 48 bp, Methanobrevibacter ruminantium
ggaaatcgattgattgcataatgagtattatgcttttttagactttaa

SEQ ID NO: 7630 - DNA, 45 bp, Methanobrevibacter ruminantium
tcctgaaatctgattgattattttatagtcttttttttattgtct

SEQ ID NO: 7631 - DNA, 47 bp, Methanobrevibacter ruminantium
ataaaaaatctcgcagataactttaagttatctttttatttattcaa

SEQ ID NO: 7632 - DNA, 58 bp, Methanobrevibacter ruminantium
agaggatgatggagagtagaaggttaatttattaatcttttgcttttttttaatttaa

SEQ ID NO: 7633 - DNA, 41 bp, Methanobrevibacter ruminantium
gaaaatattataattcttttaaaaagttttttttaaactga

SEQ ID NO: 7634 - DNA, 49 bp, Methanobrevibacter ruminantium
tcttttttttttgcattggataataattatccaatttttcttttttatt

SEQ ID NO: 7635 - DNA, 47 bp, Methanobrevibacter ruminantium
agcaaatattttttagtatttttttaaaatacttttttttattcttt

SEQ ID NO: 7636 - DNA, 49 bp, Methanobrevibacter ruminantium
taatttatagaattttgaaaaacattgtttttcattgatagatgatgaa

SEQ ID NO: 7637 - DNA, 58 bp, Methanobrevibacter ruminantium
aaaggcaattgatgatttgagttaatttttaaattaacttaaatttcttctttaatta

SEQ ID NO: 7638 - DNA, 47 bp, Methanobrevibacter ruminantium
agcattccttttcttccatatttatagtatggttttttatattattt

SEQ ID NO: 7639 - DNA, 41 bp, Methanobrevibacter ruminantium
ttatttttgttcatttttattttaaattttttttattagga

SEQ ID NO: 7640 - DNA, 54 bp, Methanobrevibacter ruminantium
ttggttctaaagatggtgtaaaatacttataatttacacttttttattttttct

SEQ ID NO: 7641 - DNA, 47 bp, Methanobrevibacter ruminantium
tttatttttaatagcttattttaagaaaataattttattttataatt

SEQ ID NO: 7642 - DNA, 48 bp, Methanobrevibacter ruminantium
ctttttttttattttttaatcaattttgattaatttttattatatcct

SEQ ID NO: 7643 - DNA, 57 bp, Methanobrevibacter ruminantium
ctaaagagttaactggcaatgattacaggtcttaatcattgcttcttttatattttt

SEQ ID NO: 7644 - DNA, 54 bp, Methanobrevibacter ruminantium
ctatgcagctgctttggataaaatcgactgattttatcctttttttaaattttg

SEQ ID NO: 7645 - DNA, 42 bp, Methanobrevibacter ruminantium
tatttattttattttgagatatatctcttttttttcaataat

SEQ ID NO: 7646 - DNA, 48 bp, Methanobrevibacter ruminantium
atcaccgctagtttttatgcttatttaagcatattttatattttttca

SEQ ID NO: 7647 - DNA, 48 bp, Methanobrevibacter ruminantium
cattaaggaaattcgtggagaataatttctccatttacttttttttat

SEQ ID NO: 7648 - DNA, 56 bp, Methanobrevibacter ruminantium
ttgaaattattttatcatattaaaactatttttttaatatgtttttataaattgaa

SEQ ID NO: 7649 - DNA, 60 bp, Methanobrevibacter ruminantium
ttaaaattgctattggaataattattttaatataaataattattctttttcttattttaa

SEQ ID NO: 7650 - DNA, 43 bp, Methanobrevibacter ruminantium
ttattctattttttttgcatttaatgcattcttttttttagat

SEQ ID NO: 7651 - DNA, 43 bp, Methanobrevibacter ruminantium
tttattctatttttttgcatttaatgcattcttttttttagat

SEQ ID NO: 7652 - DNA, 58 bp, Methanobrevibacter ruminantium
tttgaacctttaggatgggttaagttaagtaaaatttaatccattttttttattttaa

SEQ ID NO: 7653 - DNA, 58 bp, Methanobrevibacter ruminantium; identical to SEQ ID NO: 7652

SEQ ID NO: 7654 - DNA, 49 bp, Methanobrevibacter ruminantium
ttgtcataattttagggttcttttaaatagaacctttttttattttttt

SEQ ID NO: 7655 - DNA, 43 bp, Methanobrevibacter ruminantium
tttgtaaaatctaatgtattttagatacttttttattttttta

SEQ ID NO: 7656 - DNA, 49 bp, Methanobrevibacter ruminantium
tttgatttcatcttattaggttttttaaacctaatttttaattttttac

SEQ ID NO: 7657 - DNA, 50 bp, Methanobrevibacter ruminantium
cttttttttatttttttagtcttttttaagactaattttttactattttt

SEQ ID NO: 7658 - DNA, 50 bp, Methanobrevibacter ruminantium
taaggaatgtttatatggattaaaagattaatccatttccttttcaataa

SEQ ID NO: 7659 - DNA, 41 bp, Methanobrevibacter ruminantium
atttattttagctattttatcataaatttttttattttact

SEQ ID NO: 7660 - DNA, 42 bp, Methanobrevibacter ruminantium
tgttttttcacttttgcacaattgtgctttttctttttttct

SEQ ID NO: 7661 - DNA, 56 bp, Methanobrevibacter ruminantium
tttaggtgaatatttttaattggtcttaattggccaattaattttattttttttta

SEQ ID NO: 7662 - DNA, 48 bp, Methanobrevibacter ruminantium
aattgaatcctgctagtggagtttttactccacttttttttatggaaa

SEQ ID NO: 7663 - DNA, 42 bp, Methanobrevibacter ruminantium
aaaaaatctttattatgcttttgagcatttttcttttttatt

SEQ ID NO: 7664 - DNA, 45 bp, Methanobrevibacter ruminantium
tatagctttagaaattgaaatttaattttatttttttttattata

SEQ ID NO: 7665 - DNA, 49 bp, Methanobrevibacter ruminantium
atgatcacttatctttctaggttttaaacctagatttttttatttttaa

SEQ ID NO: 7666 - DNA, 45 bp, Methanobrevibacter ruminantium
tactgttcatttttggataaaacttttatctttctttttattatc

SEQ ID NO: 7667 - DNA, 48 bp, Methanobrevibacter ruminantium
tgaccaaaagttttatctcgactgtagtcgggattttactttttattt

SEQ ID NO: 7668 - DNA, 49 bp, Methanobrevibacter ruminantium
ataggatagctattcttgggatttattttcccaatttttttattttaaa

SEQ ID NO: 7669 - DNA, 49 bp, Methanobrevibacter ruminantium
taaaaaacttagatttagaattatattaattctattcttttttcttttt

SEQ ID NO: 7670 - DNA, 51 bp, Methanobrevibacter ruminantium
atcttatttatcattgaattggattatttctaattctttttatttattatt

SEQ ID NO: 7671 - DNA, 41 bp, Methanobrevibacter ruminantium
tatttatttttttaactcttttagagttttttcttatttat

SEQ ID NO: 7672 - DNA, 61 bp, Methanobrevibacter ruminantium
gtagaaaaaggtgctgaattaattaaataattcttttaattaattctttttagttttaaac

SEQ ID NO: 7673 - DNA, 41 bp, Methanobrevibacter ruminantium
tttttattttatatttagtgaaactatttttttttaaccat

SEQ ID NO: 7674 - DNA, 51 bp, Methanobrevibacter ruminantium
taatttattagcttagaaattatttaaagtaatttcttttctatttattta

SEQ ID NO: 7675 - DNA, 49 bp, Methanobrevibacter ruminantium
aagctgattatggttgagggctaatattgccttctttttttctattttt

SEQ ID NO: 7676 - DNA, 47 bp, Methanobrevibacter ruminantium
atttattttttatttttagtcttttagactaattcttttcttttttt

SEQ ID NO: 7677 - DNA, 51 bp, Methanobrevibacter ruminantium
tacaatttttatttttcctaaaagagttttttaggatttattatgaagtga

SEQ ID NO: 7678 - DNA, 51 bp, Methanobrevibacter ruminantium
tttaattatccgattttttaattatattaattaaaatttttcttctatttt

SEQ ID NO: 7679 - DNA, 50 bp, Methanobrevibacter ruminantium
gatatagaggatttattggactttgaatagtctaatttttttgtttttgt

SEQ ID NO: 7680 - DNA, 50 bp, Methanobrevibacter ruminantium
cttattttttttttattgcatattcttatatgcaattctttttttaattt

SEQ ID NO: 7681 - DNA, 51 bp, Methanobrevibacter ruminantium
tttaattagtcgttattttaattattttaattaaaatttttttcaagaaat

SEQ ID NO: 7682 - DNA, 51 bp, Methanobrevibacter ruminantium
tgtttcatgtttttggacatttgtttcccagatgtctttttgatttgcaaa

SEQ ID NO: 7683 - DNA, 45 bp, Methanobrevibacter ruminantium
tttttaattttttgttttgttattaacaaattttttcttgttaac

SEQ ID NO: 7684 - DNA, 41 bp, Methanobrevibacter ruminantium
ttatcttattattgagatttttaatctttttttattttatg

SEQ ID NO: 7685 - DNA, 52 bp, Methanobrevibacter ruminantium
attaaatcgtttttatgttgatttttaataatcaacatttattttttttaaa
